United States Patent
Nairn et al.

(10) Patent No.: US 11,866,466 B2
(45) Date of Patent: Jan. 9, 2024

(54) TUMOR HOMING AND CELL PENETRATING PEPTIDE-IMMUNO-ONCOLOGY AGENT COMPLEXES AND METHODS OF USE THEREOF

(71) Applicant: BLAZE BIOSCIENCE, INC., Seattle, WA (US)

(72) Inventors: Natalie Winblade Nairn, Seattle, WA (US); Julia Novak, Sequim, WA (US); Kenneth Grabstein, Mercer Island, WA (US); Dennis Miller, Woodinville, WA (US); Greg T. Hermanson, Loves Park, IL (US); Scott R. Presnell, Tacoma, WA (US); Mark Stroud, Seattle, WA (US)

(73) Assignee: BLAZE BIOSCIENCE, INC., Seattle, WA (US)

( * ) Notice: Subject to any disclaimer, the term of this patent is extended or adjusted under 35 U.S.C. 154(b) by 351 days.

(21) Appl. No.: 16/954,190

(22) PCT Filed: Dec. 18, 2018

(86) PCT No.: PCT/US2018/066337
§ 371 (c)(1),
(2) Date: Jun. 15, 2020

(87) PCT Pub. No.: WO2019/126240
PCT Pub. Date: Jun. 27, 2019

(65) Prior Publication Data
US 2021/0130419 A1    May 6, 2021

Related U.S. Application Data

(60) Provisional application No. 62/622,711, filed on Jan. 26, 2018, provisional application No. 62/607,893, filed on Dec. 19, 2017.

(51) Int. Cl.
| | |
|---|---|
| *A61K 38/00* | (2006.01) |
| *C07K 14/435* | (2006.01) |
| *A61K 47/65* | (2017.01) |
| *A61K 47/64* | (2017.01) |
| *A61P 35/00* | (2006.01) |
| *A61K 45/06* | (2006.01) |
| *C07K 19/00* | (2006.01) |

(52) U.S. Cl.
CPC ........ *C07K 14/43522* (2013.01); *A61K 45/06* (2013.01); *A61K 47/64* (2017.08); *A61K 47/65* (2017.08); *A61P 35/00* (2018.01); *C07K 19/00* (2013.01)

(58) Field of Classification Search
None
See application file for complete search history.

(56) References Cited

U.S. PATENT DOCUMENTS

| | | | |
|---|---|---|---|
| 5,905,027 | A | 5/1999 | Ullrich et al. |
| 6,028,174 | A | 2/2000 | Ullrich et al. |
| 6,319,891 | B1 | 11/2001 | Sontheimer et al. |
| 6,429,187 | B1 | 8/2002 | Sontheimer et al. |
| 6,667,156 | B2 | 12/2003 | Lyons et al. |
| 6,870,029 | B2 | 3/2005 | Sontheimer et al. |
| 9,018,347 | B2 | 4/2015 | Sentissi et al. |
| 9,944,683 | B2 | 4/2018 | Olson |
| 2003/0021810 | A1 | 1/2003 | Sontheimer et al. |
| 2003/0031669 | A1 | 2/2003 | Goldenberg |
| 2006/0088899 | A1 | 4/2006 | Alvarez et al. |
| 2006/0166892 | A1 | 7/2006 | Alvarez et al. |
| 2008/0153746 | A1 | 6/2008 | Alvarez et al. |
| 2009/0142266 | A1 | 6/2009 | Ronjat et al. |
| 2009/0324538 | A1 | 12/2009 | Wong et al. |
| 2010/0215575 | A1 | 8/2010 | O'Neill et al. |
| 2013/0028836 | A1 | 1/2013 | Sentissi et al. |

(Continued)

FOREIGN PATENT DOCUMENTS

| | | | |
|---|---|---|---|
| AU | 2003237347 A1 * | 12/2003 | ............. A61K 31/00 |
| CA | 2993891 A1 | 1/2017 | |

(Continued)

OTHER PUBLICATIONS

Chen et al. (Cancer Biology & Therapy 16:9, 1415--1421; Sep. 2015). A targeted IL-15 fusion protein with potent anti-tumor activity. (Year: 2015).*
Akdag, et al. The Uptake Mechanism of the Cell-Penetrating pVEC Peptide. J. Chem. 2013, 1-9 (2013).
Akhmedov, D., et al. Knock-in luciferase reporter mice for in vivo monitoring of CREB activity. PLoS One 11, 1-13 (2016).
Almagro et al.: Progress and Challenges in the Design and Clinical Development of Antibodies for Cancer Therapy. Frontiers in immunology; 8, 1751 (2018) doi:10.3389/fimmu.2017.01751 https://www.frontiersin.org/articles/10.3389/fimmu.2017.01751/full.
Altschul, et al. Optimal sequence alignment using affine gap costs. Bulletin of Mathematical Biology. 1986; 48(5-6):603-16.

(Continued)

*Primary Examiner* — Aradhana Sasan
*Assistant Examiner* — Mercy H Sabila
(74) *Attorney, Agent, or Firm* — DLA PIPER LLP; Melissa Harwood

(57) ABSTRACT

Peptide-immuno-oncology agent complexes ("peptide-I/O complexes") that can home, target, migrate to, are directed to, are retained by, accumulate in, penetrate, or bind to the tumor microenvironment, tumor tissues, or cells or compartments or cytosol of cells thereof, or any combination thereof, are disclosed. Additionally disclosed are peptide-I/O complexes that can cross the blood-brain barrier. Pharmaceutical compositions and uses for peptide-I/O complexes comprising such peptides are also disclosed. Such compositions can be formulated for targeted delivery of an immuno-oncology agent ("I/O") to the tumor microenvironment. Targeted compositions of the disclosure can deliver peptide-I/O complexes to target regions, tissues, structures or cells targeted by the peptide.

22 Claims, 90 Drawing Sheets

Specification includes a Sequence Listing.

(56) References Cited

U.S. PATENT DOCUMENTS

| | | |
|---|---|---|
| 2013/0164220 A1 | 6/2013 | Yu et al. |
| 2013/0195760 A1 | 8/2013 | Olson |
| 2013/0280281 A1 | 10/2013 | Castaigne et al. |
| 2014/0134128 A1 | 5/2014 | Wong et al. |
| 2014/0179560 A1 | 6/2014 | Olson et al. |
| 2015/0080721 A1 | 3/2015 | Novak et al. |
| 2017/0304342 A1 | 10/2017 | Cox et al. |
| 2019/0117728 A1 | 4/2019 | Olson et al. |

FOREIGN PATENT DOCUMENTS

| | | | |
|---|---|---|---|
| CN | 101583370 A | 11/2009 | |
| EP | 1777294 A1 | 4/2007 | |
| EP | 2072060 A1 * | 6/2009 | ......... A61K 47/6415 |
| EP | 2182004 A1 | 5/2010 | |
| EP | 3235830 A1 | 10/2017 | |
| JP | 2013224283 A | 10/2013 | |
| WO | WO-9724619 A1 | 7/1997 | |
| WO | WO-0062807 A1 | 10/2000 | |
| WO | WO-03082196 A2 | 10/2003 | |
| WO | WO-03101474 A1 | 12/2003 | |
| WO | WO-03101475 A1 | 12/2003 | |
| WO | WO-2005099774 A2 | 10/2005 | |
| WO | WO-2007117467 A2 | 10/2007 | |
| WO | WO-2008063291 A2 | 5/2008 | |
| WO | WO-2009021136 A1 | 2/2009 | |
| WO | WO-2009049184 A2 | 4/2009 | |
| WO | WO-2009117018 A1 | 9/2009 | |
| WO | WO-2009140599 A1 | 11/2009 | |
| WO | WO-2011070214 A2 | 6/2011 | |
| WO | WO-2011097533 A1 | 8/2011 | |
| WO | WO-2011142858 A2 | 11/2011 | |
| WO | WO-2012064658 A1 | 5/2012 | |
| WO | WO-2013003507 A1 * | 1/2013 | ......... A61K 47/6415 |
| WO | WO-2013078250 A2 | 5/2013 | |
| WO | WO-2014063012 A1 | 4/2014 | |
| WO | WO-2014093406 A1 | 6/2014 | |
| WO | WO-2014180534 A1 | 11/2014 | |
| WO | WO-2015018529 A1 * | 2/2015 | ......... A61K 38/1793 |
| WO | WO-2015042202 A1 | 3/2015 | |
| WO | WO-2015179635 A2 | 11/2015 | |
| WO | WO-2016112208 A2 | 7/2016 | |
| WO | WO-2016118859 A1 | 7/2016 | |
| WO | WO-2016210376 A2 | 12/2016 | |
| WO | WO-2017044894 A2 | 3/2017 | |
| WO | WO-2017100700 A2 | 6/2017 | |
| WO | WO-2017136769 A1 | 8/2017 | |
| WO | WO-2017143259 A1 | 8/2017 | |
| WO | WO-2017180789 A2 | 10/2017 | |
| WO | WO-2017181149 A1 | 10/2017 | |
| WO | WO-2018049285 A1 | 3/2018 | |
| WO | WO-2018119001 A1 | 6/2018 | |
| WO | WO-2018136614 A1 | 7/2018 | |
| WO | WO-2018170480 A1 | 9/2018 | |
| WO | WO-2019055840 A1 | 3/2019 | |

OTHER PUBLICATIONS

Appelbaum, et al. Arginine Topology Controls Escape of Minimally Cationic Proteins from Early Endosomes to the Cytoplasm. Chem. Biol. 19, 819-830 (2012).

Assal et al. Emerging targets in cancer immunotherapy: beyond CTLA-4 and PD-1. Immunotherapy. 2015;7(11):1169-86.

Baar, et al. Targeted apoptosis of senescent cells restores tissue homeostasis in response to chemotoxicity and aging. Cell 169.1 (2017): 132-147.

Baik, et al. Fluorescence Identification of Head and Neck Squamous Cell Carcinoma and High-Risk Oral Dysplasia With BLZ-100, a Chlorotoxin-Indocyanine Green Conjugate. JAMA Otolaryngol Head Neck Surg. Published on line Feb. 18, 2016. doi: 10.1001/jamaoto. 2015.3617; JAMA Otolaryngol Head Neck Surg. Apr. 1, 2016; 142(4): 330-338.

Baker et al. Electrostatics of nanosystems: application to microtubules and the ribosome. Proc Natl Acad Sci U S A.Aug. 28, 2001;98(18):10037-41.

Balayssac, et al. Comparison of Penetratin and Other Homeodomain-Derived Cell-Penetrating Peptides: Interaction in a Membrane-Mimicking Environment and Cellular Uptake Efficiency. Biochemistry 45, 1408-1420 (2006).

Bandaranayake, et al. Daedalus: a robust, turnkey platform for rapid production of decigram quantities of active recombinant proteins in human cell lines using novel lentiviral vectors. Nucleic Acids Res. Nov. 2011;39(21):e143. doi: 10.1093/nar/gkr706. Epub Sep. 12, 2011.

Bao, et al. The tripeptide phenylalanine-(D) glutamate-(D) glycine modulates leukocyte infiltration and oxidative damage in rat injured spinal cord. Neuroscience. Jul. 7, 2006;140(3):1011-22. Epub Apr. 3, 2006.

Barchetta et al. Neurotensin Is a Lipid-Induced Gastrointestinal Peptide Associated with Visceral Adipose Tissue Inflammation in Obesity. Nutrients 10, 526 (2018).

Barton, Geoffrey J. Protein secondary structure prediction. Curr Opin Struct Biol. Jun. 1995;5(3):372-6.

Bendtsen, et al. Improved prediction of signal peptides: SignalP 3.0. Journal of molecular biology 340.4 (2004): 783-795.

Berger, et al. Computationally designed high specificity inhibitors delineate the roles of BCL2 family proteins in cancer. Elife 5, (2016).

Berman, et al. The protein data bank. Nucleic acids research 28.1 (2000): 235-242.

Bernard et al. Identification of an interleukin-15alpha receptor-binding site on human interleukin-15. J Biol Chem. Jun. 4, 2004;279(23):24313-22.

Bhardwaj, et al. Accurate de novo design of hyperstable constrained peptides. Nature 538, 329-335 (2016).

Bjellqvist et al. Reference points for comparisons of two-dimensional maps of proteins from different human cell types defined in a pH scale where isoelectric points correlate with polypeptide compositions. Electrophoresis. Mar.-Apr. 1994;15(3-4):529-39.

Bjellqvist et al. The focusing positions of polypeptides in immobilized pH gradients can be predicted from their amino acid sequences. Electrophoresis. Oct. 1993;14(10):1023-31.

Bodenhofer, et al. msa: an R package for multiple sequence alignment. Bioinformatics31.24 (2015): 3997-3999.

Bohlen, et al. A bivalent tarantula toxin activates the capsaicin receptor, TRPV1, by targeting the outer pore domain. Cell 141, 834-845 (2010).

Boisseau, et al. Cell penetration properties of maurocalcine, a natural venom peptide active on the intracellular ryanodine receptor. Biochim. Biophys. Acta—Biomembr. 1758, 308-319 (2006).

Boswell, C. A. et al. Comparative Physiology of Mice and Rats: Radiometric Measurement of Vascular Parameters in Rodent Tissues. (2014).

Bouchaud et al. The exon-3-encoded domain of IL-15ralpha contributes to IL-15 high-affinity binding and is crucial for the IL-15 antagonistic effect of soluble IL-15Ralpha. J Mol Biol. Sep. 26, 2008;382(1):1-12.

Boules, et el, Diverse roles of neurotensin agonists in the centralnervous system; Front Endocrinol (Lausanne). 2013; 4: 36.

Brüggemann, M. et al. Human Antibody Production in Transgenic Animals. Arch. Immunol. Ther. Exp. (Warsz). 63, 101-8 (2015).

Bruno, et al. Basics and recent advances in peptide and protein drug delivery. Ther Deliv. Nov. 2013;4(11):1443-67.

Butte, et al. Near-infrared imaging of brain tumors using the Tumor Paint BLZ-100 to achieve near-complete resection of brain tumors. Neurosurg Focus. Feb. 2014;36(2):E1.

Carver, et al. The design of Jemboss: a graphical user interface to EMBOSS. Bioinformatics. Sep. 22, 2003;19(14):1837-43.

Chen, et al., A targeted IL-15 fusion protein with potent anti-tumor activity . Cancer biology & therapy. Sep. 2015. vol. 16 No. 8, pp. 1415-1421; abstract; p. 1416, 1st column, 1st paragraph; p. 1416.

Chen, et al. The application of aptamer in apoptosis. Biochimie. vol. 132, Jan. 2017, pp. 1-8. Available online Oct. 14, 2016.

(56) References Cited

OTHER PUBLICATIONS

Chen, et al. Toxin acidic residue evolutionary function-guided design of de novo peptide drugs for the immunotherapeutic target, the Kv1. 3 channel. Scientific reports 5 (2015): 9881.

Chen, et al. Unusual binding mode of scorpion toxin BmKTX onto potassium channels relies on its distribution of acidic residues. Biochemical and biophysical research communications 447.1 (2014): 70-76.

Chen, J. et al., Protein-protein interactions: General trends in the relationship between binding affinity and interfacial buried surface area. Protein Sci. 22, 510-515 (2013).

Choi, et al. A general strategy for generating intact, full-length IgG antibodies that penetrate into the cytosol of living cells. MAbs 6, 1402-1414 (2014).

Collaborative computational Project, No. 4. The CCP4 suite: programs for protein crystallography. Acta Crystallogr. D Biol. Crystallogr. 50:760-763 (1994).

Corbi-Verge, et al. Strategies to Develop Inhibitors of Motif-Mediated Protein-Protein Interactions as Drug Leads. Annu. Rev. Pharmacol. Toxicol. 57, 39-60 (2017).

Cordes, et al. Sequence space, folding and protein design. Curr Opin Struct Biol. Feb. 1996;6(1):3-10.

Corrales et al. Direct Activation of STING in the Tumor Microenvironment Leads to Potent and Systemic Tumor Regression and Immunity. Cell Rep. May 19, 2015;11(7):1018-30.

Correnti, et al. Screening, large-scale production, and structure-based classification for cystine-dense peptides. Nat Struct Mol Biol. Mar. 2018; 25(3): 270-278.

Craik et al., Potential therapeutic applications of the cyclotides and related cystine knot mini-proteins. Expert Opin. Investig. Drugs 16, 595-604 (2007).

Crook, Z. R. et al. Mammalian display screening of diverse cystine-dense peptides for difficult to drug targets. Nat. Commun. 8, 2244 (2017).

Daly, et al. Bioactive cystine knot proteins. Curr Opin Chem Biol. Jun. 2011;15(3):362-8. doi: 10.1016/j.cbpa.2011.02.008. Epub Feb. 27, 2011.

Daniels, T. R. et al. The transferrin receptor and the targeted delivery of therapeutic agents against cancer. Biochim. Biophys. Acta - Gen. Subj. 1820, 291-317 (2012).

Davis, et al. MolProbity: all-atom contacts and structure validation for proteins and nucleic acids. Nucleic acids research 35.suppl_2 (2007): W375-W383.

De Coupade, et al. Novel human-derived cell-penetrating peptides for specific subcellular delivery of therapeutic biomolecules. Biochem. J. 390, 407-418 (2005).

Derakhshankhah H et al.; Cell penetrating peptides: A concise review with emphasis on biomedical applications; Biomed Pharmacother. Dec. 2018;108:1090-1096. doi: 10.1016/j.biopha. 2018.09.097. Epub Sep. 28, 2018.

Devarkar et al. Structural basis for m7G recognition and 2'-O-methyl discrimination in capped RNAs by the innate immune receptor RIG-I. Proc Natl Acad Sci U S A. Jan. 19, 2016;113(3):596-601.

Dohmen, et al. Multifunctional CPP polymer system for tumor-targeted pDNA and siRNA delivery. Methods Mol Biol. 2011;683:453-63. doi: 10.1007/978-1-60761-919-2_32.

Dolinsky et al. PDB2PQR: expanding and upgrading automated preparation of biomolecular structures for molecular simulations. Nucleic Acids Res.Jul. 2007;35(Web Server issue):W522-5.

Dou, et al. Overview of proteasome inhibitor-based anti-cancer therapies: perspective on bortezomib and second generation proteasome inhibitors versus future generation inhibitors of ubiquitin-proteasome system. Curr Cancer Drug Targets. 2014;14(6):517-36.

D'Souza, et al. Structural parameters modulating the cellular uptake of disulfide-rich cyclic cell-penetrating peptides: MCoTI-II and SFTI-1. Eur. J. Med. Chem. 88, 10-18 (2014).

Drin, et al. Physico-chemical requirements for cellular uptake of pAntp peptide: Role of lipid-binding affinity. Eur. J. Biochem. 268, 1304-1314 (2001).

Duchardt, et al. A cell-penetrating peptide derived from human lactoferrin with conformation-dependent uptake efficiency. J. Biol .Chem. 284, 36099-108 (2009).

Duewell et al. RIG-I-like helicases induce immunogenic cell death of pancreatic cancer cells and sensitize tumors toward killing by CD8(+) T cells. Cell Death Differ. Dec. 2014;21(12):1825-37.

Dulhunty, et al. Multiple actions of imperatoxin A on ryanodine receptors: Interactions with the II-III loop 'A' fragment. J. Biol. Chem. 279, 11853-11862 (2004).

Elmallah, et al. Marine Drugs Regulating Apoptosis Induced by Tumor Necrosis Factor-Related Apoptosis-Inducing Ligand (TRAIL). Mar Drugs. Nov. 13, 2015;13(11):6884-909. doi: 10.3390/md13116884.

Emboss iep. Available at http://emboss.sourceforge.net/apps/release/6.6/emboss/apps/iep.html. Accessed on Dec. 26, 2018.

Emsley et al. Coot: model-building tools for molecular graphics. Acta crystallographica Section D, Biological crystallography 60:2126-2132 (2004).

EP16815459.9 Extended European Search Report dated Nov. 28, 2018.

EP16845226.6 The Extended European Search Report dated Mar. 28, 2019.

EP16874006.6 The Extended European Search Report dated Jul. 30, 2019.

EP16874006.6 The partial Supplemental European Search Report dated Apr. 24, 2019.

EP17849695.6 The Extended European Search Report dated Apr. 1, 2020.

Erazo-Oliveras, et al. Protein delivery into live cells by incubation with an endosomolytic agent. Nat. Methods 11, 861-867 (2014).

Esteve, et al. Critical amino acid residues determine the binding affinity and the Ca 2+ release efficacy of maurocalcine in skeletal muscle cells. J. Biol. Chem. 278, 37822-37831 (2003).

Everts, S. Can we hit the snooze button on aging ?. Chemical & Engineering News 95.10 (Mar. 6, 2017): 31-35.

Farkona et al. Cancer immunotherapy: the beginning of the end of cancer? BMC Med. May 5, 2016;14:73.

Fidel et al. Preclinical Validation of the Utility of BLZ-100 in Providing Fluorescence Contrast for Imaging Spontaneous Solid Tumors. Cancer Res. Oct. 15, 2015;75(20):4283-91.

Finton, et al. Autoreactivity and Exceptional CDR Plasticity (but Not Unusual Polyspecificity) Hinder Elicitation of the Anti-HIV Antibody 4E10. PLoS Pathog. 9, e1003639 (2013).

Fischer, et al. Apoptosis-based therapies and drug targets. Cell Death Differ. Aug. 2005;12 Suppl 1:942-61.

Furtek, et al. Strategies and Approaches of Targeting STAT3 for Cancer Treatment. ACS Chem. Biol. 11, 308-318 (2016).

Gao et al. Structure-function analysis of STING activation by c[G(2',5')pA(3',5')p] and targeting by antiviral DMXAA. Cell. Aug. 15, 2013;154(4):748-62.

Garcia, et al. Constitutive activation of Stat3 by the Src and JAK tyrosine kinases participates in growth regulation of human breast carcinoma cells. Oncogene 20, 2499-2513 (2001).

Gasteiger, et al. Protein Identification and Analysis Tools on the ExPASy Server. Excerpt, available at: http://web.expasy.org/compute_pi/pi_tool-doc.html. Accessed Nov. 7, 2018.

Gasteiger, et al. Protein Identification and Analysis Tools on the ExPASy Server. (In) John M. Walker (ed): The Proteomics Protocols Handbook, Humana Press (2005; pp. 571-607).

Gautam, et al. Topical Delivery of Protein and Peptide Using Novel Cell Penetrating Peptide IMT-P8. Sci. Rep. 6, 26278 (2016).

Gelly, et al. The KNOTTIN website and database: a new information system dedicated to the knottin scaffold. Nucleic acids research 32.suppl_1 (2004): D156-D159.

Gibson, et al. BCL-2 Antagonism to Target the Intrinsic Mitochondrial Pathway of Apoptosis. Clin Cancer Res. Nov. 15, 2015;21(22):5021-9. doi: 10.1158/1078-0432.CCR-15-0364.

Goldeck et al. Enzymatic synthesis and purification of a defined RIG-I ligand. Methods Mol Biol. 2014;1169:15-25.

Gould, et al. Cyclotides, a novel ultrastable polypeptide scaffold for drug discovery. Current pharmaceutical design 17.38 (2011): 4294-4307.

(56) References Cited

OTHER PUBLICATIONS

Gump, et al. TAT transduction: the molecular mechanism and therapeutic prospects. Trends Mol Med. Oct. 2007;13(10):443-8.
Guo et al. Immunobiology of the IL-15/IL-15Rα complex as an antitumor and antiviral agent. Cytokine Growth Factor Rev. Dec. 2017;38:10-21.
Gurrola, et al. Imperatoxin A, a Cell-Penetrating Peptide from Scorpion Venom, as a Probe of Ca-Release Channels/Ryanodine Receptors. Pharmaceuticals (Basel). 3, 1093-1107 (2010).
Hamman, et al. Oral delivery of peptide drugs: barriers and developments. BioDrugs. 2005;19(3):165-77.
Han, et al. IL-15:IL-15 receptor alpha superagonist complex: High-level co-expression in recombinant mammalian cells, purification and characterization. Cytokine. Dec. 2011; 56(3):804-810.
Han, et al. Structural basis of a potent peptide inhibitor designed for Kv1.3 channel, a therapeutic target of autoimmune disease. Journal of Biological Chemistry 283.27 (2008):19058-19065.
Harada, et al. Antitumor protein therapy; application of the protein transduction domain to the development of a protein drug for cancer treatment. Breast Cancer. 2006;13(1):16-26.
Henikoff et al. Amino acid substitution matrices from protein blocks. Pnas USA 89(22):10915-10919 (1992).
Hermans et al., Phospholipase C activation by neurotensin and neuromedin N in Chinese hamster ovary cells expressing the rat neurotensin receptor. Molecular Brain Research, 1992; 15: 332-338.
Herzig, et al. The Cystine Knot Is Responsible for the Exceptional Stability of the Insecticidal Spider Toxin ω-Hexatoxin-Hv1a. Toxins (Basel). Oct. 2015; 7(10): 4366-4380.
Hockaday, et al., Imaging Glioma Extent with 131i-TM-601, J. Nuc. Med. 46(4): 580-586 (2005).
Hoos, Axel. Development of immuno-oncology drugs—from CTLA4 to PD1 to the next generations. Nat Rev Drug Discov. Apr. 2016;15(4):235-47.
Hornung et al. 5'-Triphosphate RNA is the ligand for RIG-I. Science. Nov. 10, 2006;314(5801):994-7.
Hu et al. The endosomal-lysosomal system: from acidification and cargo sorting to neurodegeneration. Transl Neurodegener. 2015; 4: 18.
IUPHAR/BPS. Guide to Pharmacology—Tumour necrosis factor (TNF) receptor family. Available at: http://www.guidetopharmacology.org/GRAC/FamilyDisplayForward?familyId=334. Accessed Nov. 7, 2018.
Iyer, et al. Tying the knot: The cystine signature and molecular-recognition processes of the vascular endothelial growth factor family of angiogenic cytokines. The FEBS journal 278.22 (2011): 4304-4322.
Jang, et al. A nucleic acid-hydrolyzing antibody penetrates into cells via caveolae-mediated endocytosis, localizes in the cytosol and exhibits cytotoxicity. Cell. Mol. Life Sci. 66, 1985-1997 (2009).
Janzer, et al. Drug conjugation affects pharmacokinetics and specificity of kidney-targeted peptide carriers, Bioconjugate chemistry 27.10 (2016):2441-2449.
Juliano, Rudolph L. The delivery of therapeutic oligonucleotides. Nucleic Acids Res. Aug. 19, 2016;44(14):6518-48.
Karlsson, R., et al., Analyzing a kinetic titration series using affinity biosensors. Anal. Biochem. 349, 136-147 (2006).
Kato et al. RIG-I-Like Receptors and Type I Interferonopathies. J Interferon Cytokine Res. May 2017;37(5):207-213.
Kern, et al. Enzyme-Cleavable Polymeric Micelles for the Intracellular De-livery of Pro-Apoptotic Peptides. Mol Pharm. May 1, 2017;14(5):1450-1459. doi: 10.1021/acs.molpharmaceut.6b01178. Epub Mar. 30, 2017.
Kikuchi, et al., High proteolytic resistance of spider-derived inhibitor cystine knots. Int. J. Pept. 2015, (2015).
Kimura, et al. Engineered cystine knot peptides that bind αvβ3, αvβ5, and α5β1 integrins with low-nanomolar affinity. Proteins Struct. Funct. Bioinforma. 77, 359-369 (2009).
Kintizing, et al. Engineered knottin peptides as diagnostics, therapeutics, and drug delivery vehicles. Current opinion in chemical biology 34 (2016): 143-150.
Kirkland, et al. Clinical strategies and animal models for developing senolytic agents. Exp Gerontol. Aug. 2015;68:19-25. doi: 10.1016/j.exger.2014.10.012. Epub Oct. 28, 2014.
Kirkland, James L. Translating Advances from the Basic Biology of Aging into Clinical Application. Exp Gerontol. Jan. 2013; 48(1): 1-5. Published online Dec. 10, 2012. doi: 10.1016/j.exger.2012.11.014.
Kolmar, H. Biological diversity and therapeutic potential of natural and engineered cystine knot miniproteins. Current opinion in pharmacology 9.5 (2009): 608-614.
Kolmar, H. Natural and engineered cystine knot miniproteins for diagnostic and therapeutic applications. Current pharmaceutical design 17.38 (2011): 4329-4336.
Kozminsky-Atias, et al. Isolation of the first toxin from the scorpion Buthus occitanus israelis showing preference for Shaker potassium channels. FEBS letters 581.13 (2007): 2478-2484.
Krezel, et al. Solution structure of the potassium channel inhibitor agitoxin 2: caliper for probing channel geometry. Protein Science 4.8 (1995): 1478-1489.
Kumari, et al. Cysteine-Rich Peptide Family with Unusual Disulfide Connectivity from Jasminum sambac. J Nat Prod. Nov. 25, 2015;78(11):2791-9. doi: 10.1021/acs.jnatprod.5b00762. Epub Nov. 10, 2015.
Lange, et al. Classical Nuclear Localization Signals: Definition, Function, and Interaction with Importin α*,s. J Biol Chem. Feb. 23, 2007; 282(8): 5101-5105.
Larking, et al. Clustal W and Clustal X version 2.0. Bioinformatics applications note. 2007. 2947-2948; 23(21).
Lee et al. Structural features of influenza A virus panhandle RNA enabling the activation of RIG-I independently of 5'-triphosphate. Nucleic Acids Res. Sep. 30, 2016;44(17):8407-16. With Supplemental Data (7 pages).
Li et al. Hydrolysis of 2'3'-cGAMP by ENPP1 and design of nonhydrolyzable analogs. Nat Chem Biol. Dec. 2014;10(12):1043-8.
Li, et al. Mitochondria and apoptosis: emerging concepts. F1000Prime Rep. 2015; 7: 42. Published online Apr. 1, 2015. doi: 10.12703/P7-42.
Li et al. Promising Targets for Cancer Immunotherapy: TLRs, RLRs, and STING-Mediated Innate Immune Pathways. Int J Mol Sci. Feb. 14, 2017;18(2): 1-19.
Li et al. Regulating STING in health and disease. J Inflamm (Lond). Jun. 7, 2017;14:11.
Li, Z. et al. Influence of molecular size on tissue distribution of antibody fragments. MAbs 8, 113-9 (2016).
Lim, et al. A Cancer Specific Cell-Penetrating Peptide, BR2, for the Efficient Delivery of an scFv into Cancer Cells. PLOS One, Jun. 2013; 8(6):1-11.
Ling et al., Molecular mechanism of the sea anemone toxin ShK recognizing the Kv1.3 channel explored by docking and molecular dynamic simulations. J. Chem. Inf. Model. 47, 1967-1972 (2007).
Lioux et al. Design, Synthesis, and Biological Evaluation of Novel Cyclic Adenosine-Inosine Monophosphate (cAIMP) Analogs That Activate Stimulator of Interferon Genes (Sting). J. Med. Chem., 2016, 59 (22), pp. 10253-10267.
Liu et al. A cell-based high throughput screening assay for the discovery of cGAS-STING pathway agonists. Antiviral Res. Nov. 2017; 147:37-46.
Liu, et al., Dual receptor recognizing cell penetrating peptide for selective targeting, efficient intratumoral diffusion and synthesized anti-glioma therapy. Theranostics. Jan. 1, 2016. vol. 6, No. 2, pp. 177-191.
Liu, et al. Robust structural analysis of native biological macromolecules from multi-crystal anomalous diffraction data. Acta Crystallographica Section D: Biological Crystallography 69.7 (2013): 1314-1332.
Ma, et al. Engineered nanoparticles induce cell apoptosis: potential for cancer therapy. Oncotarget. Jun. 28, 2016;7(26):40882-40903. doi: 10.18632/oncotarget.8553.
Maillere, et al. Immunogenicity of a disulphide-containing neurotoxin: presentation to T-cells requires a reduction step. Toxicon, 1995; 33(4): 475-482.

(56) References Cited

OTHER PUBLICATIONS

Mamelak, et al. Phase I single-dose study of intracavitary-administered iodine-131-TM-601 in adults with recurrent high-grade glioma. J Clin Oncol. Aug. 1, 2006;24(22):3644-50.
McCoy, et al. Phaser crystallographic software. J Appl Crystallogr. Aug. 1, 2007;40(Pt 4):658- 674. Epub Jul. 13, 2007.
Mitchell, et al. Polyarginine enters cells more efficiently than other polycationic homopolymers. J. Pept. Res. 56, 318-25 (2000).
Mitragotri, et al. Overcoming the challenges in administering biopharmaceuticals: formulation and delivery strategies. Nat Rev Drug Discov. Sep. 2014;13(9):655-72.
Montagne, et al. The max b-HLH-LZ can transduce into cells and inhibit c-Myc transcriptional activities. PLOS One 7, 2-10 (2012).
Moore, et al. Engineering knottins as novel binding agents. Methods Enzymol. 2012;503:223-51.
Moore, et al. Knottins: disulfide-bonded therapeutic and diagnostic peptides. Drug Discovery Today: TechnologiesVolume 9, Issue 1, Spring 2012, pp. e3-e11.
Moroz, et al. Oral delivery of macromolecular drugs: Where we are after almost 100years of attempts. Adv Drug Deliv Rev. Jun. 1, 2016;101:108-121.
Mortier, et al. Soluble interleukin-15 receptor alpha (IL-15R alpha)-sushi as a selective and potent agonist of IL-15 action through IL-15R beta/gamma. Hyperagonist IL-15 x IL-15R alpha fusion proteins.J Biol Chem. Jan. 20, 2006;281(3):1612-9. Epub Nov. 11, 2005.
Mouhat, et al. Diversity of folds in animal toxins acting on ion channels. Biochem. J. 378, 717-26 (2004).
Moura, et al. Relative amino acid composition signatures of organisms and environments. PloS one 8.10 (2013): e77319.
Moyse, E. et al. Distribution of neurotensin binding sites in rat brain: A light microscopic radioautographic study using monoiodo [125I]Tyr3-neurotensin. Neuroscience 22, 525-536 (1987).
Murshudov et al. Refinement of macromolecular structures by the maximum-likelihood method. Acta Cryst D53:240-255 (1997).
Mustain, et al., The role of neurotensin in physiologic and pathologic processes. Curr. Opin. Endocrinol. Diabetes Obes. 18, 75-82 (2011).
Myszka, D. G. Improving biosensor analysis. J. Mol. Recognit. 12, 279-284 (1999).
Nagase et al.: Substrate specificity of MMPs; Matrix Metalloproteinase Inhibitors in Cancer Therapy; Clendeninn & Appelt Eds., Springer Science Media New York; 39-66 (2001).
Nagase, Hideaki. Substrate Specificity of MMPs. Chapter 2. Matrix Metalloproteinase Inhibitors in Cancer Therapy. Cancer Drug Discovery and Development. Humana Press, Totowa, NJ. pp. 39-66, 2001.
Needleman et al. A general method applicable to the search for similarities in the amino acid sequence of two proteins. J. Mol. Biol. 48:443-453 (1970).
Nelson, et al. Myristoyl-based transport of peptides into living cells. Biochemistry 46, 14771-14781 (2007).
Nielsen et al. NN-align. An artificial neural network-based alignment algorithm for MHC class II peptide binding prediction. BMC Bioinformatics.Sep. 18, 2009;10:296.
Nielsen, et al., Prediction of MHC class II binding affinity using SMM-align, a novel stabilization matrix alignment method. BMC Bioinformatics, vol. 8, Article No. 238 (2007): 1-12.
Njiojob et al. Tailored near-infrared contrast agents for image guided surgery. J Med Chem. Mar. 26, 2015;58(6):2845-54.
Ojeda, et al. Lysine to arginine mutagenesis of chlorotoxin enhances its cellular uptake. Biopolymers 1-76 (2017). doi:10.1002/bip. 23025.
Ojeda et al. (Review: Chlorotoxin: Structure, Activity, and Potential Uses in Cancer Therapy; PeptideScience vol. 106, No. 1; Sep. 29, 2015).
Otwinowski et al. Processing of X-ray diffraction data collected in oscillation mode. Method Enzymol 276:307-326 (1997).
PCT/US16/66007 International Search Report and Written Opinion dated May 24, 2017.
PCT/US2016/039431 International Search Report and Written Opinion dated Jan. 13, 2017.
PCT/US2016/051166 International Preliminary Report on Patentability dated Mar. 22, 2018.
PCT/US2016/051166 International Search Report dated Mar. 23, 2017.
PCT/US2018/023006 International Search Report and Written Opinion dated Jul. 27, 2018.
PCT/US2018/037544 International Search Report and Written Opinion dated Oct. 26, 2018.
PCT/US2018/066337 International Search Report and Written Opinion dated Apr. 30, 2019.
PCT/US2019/022630 International Search Report and Written Opinion dated Jul. 5, 2019.
Pearson et al. Improved Tools for Biological Sequence Comparison. PNAS USA 85:2444-48 (1988).
Pearson. Rapid and sensitive sequence comparison with FASTP and FASTA. Meth. Enzymol. 183:63-98 (1990).
Poillot, et al. Small efficient cell-penetrating peptides derived from scorpion toxin maurocalcine. J. Biol. Chem. 287, 17331-17342 (2012).
Pooga, et al. Cell penetration by transportan. FASEB J. 12, 67-77 (1998).
Potterton et al., A graphical user interface to the CCP4 program suite. Acta Crystallogr.—Sect. D Biol. Crystallogr. (2003). doi:10. 1107/S0907444903008126.
Probst et al. A small-molecule IRF3 agonist functions as an influenza vaccine adjuvant by modulating the antiviral immune response. Vaccine. Apr. 4, 2017;35(15):1964-1971.
Procko, et al. A computationally designed inhibitor of an Epstein-Barr viral Bcl-2 protein induces apoptosis in infected cells. Cell 157, 1644-56 (2014).
Qian, et al. Early endosomal escape of a cyclic cell-penetrating peptide allows effective cytosolic cargo delivery. Biochemistry. Jun. 24, 2014;53(24):4034-46.
Quintas-Cardama, et al. Molecular pathways: JAK/STAT pathway: Mutations, inhibitors, and resistance. Clin. Cancer Res. 19, 1933-1940 (2013).
Rashid, M. H. et al. A potent and Kv1.3-selective analogue of the scorpion toxin HsTX1 as a potential therapeutic for autoimmune diseases. Scientific Reports, Mar. 2014; 4(4509): 1-9.
Rees, et al. Refined crystal structure of the potato inhibitor complex of carboxypeptidase A at 2.5 A resolution. J. Mol. Biol. 160, 475-98 (1982).
Reinwarth, et al. Chemical synthesis, backbone cyclization and oxidative folding of cystine-knot peptides—promising scaffolds for applications in drug design. Molecules 17.11 (2012): 12533-12552.
Renisio, et al. Solution structure of BmKTX, a K+ blocker toxin from the Chinese scorpion *Buthus martensi*. Proteins: Structure, Function, and Bioinformatics 38.1 (2000): 70-78.
Rhee, et al. Mechanism of uptake of C105Y, a novel cell-penetrating peptide. J. Biol. Chem. 281, 1233-1240 (2006).
Ricci, et al. Chemotherapeutic approaches for targeting cell death pathways. Oncologist. Apr. 2006;11(4):342-57.
Rice, et al. EMBOSS: the European Molecular Biology Open Software Suite. Trends Genet. Jun. 2000;16(6):276-7.
Robinson et al. The potential and promise of IL-15 in immuno-oncogenic therapies. Immunol Lett. Oct. 2017; 190:159-168.
Said, et al. The anti-HIV cytokine midkine binds the cell surface-expressed nucleolin as a low affinity receptor. J Biol Chem. Oct. 4, 2002;277(40):37492-502. Epub Jul. 29, 2002.
Sali et al. Characterization of a Novel Human-Specific STING Agonist that Elicits Antiviral Activity Against Emerging Alphaviruses. PLoS Pathog. Dec. 8, 2015;11(12):e1005324.
Samy, et al. Animal venoms as antimicrobial agents. Biochem Pharmacol. Jun. 15, 2017;134:127-138. doi: 10.1016/j.bcp.2017.03. 005. Epub Mar. 10, 2017.
Sangphukieo, et al. Computational Design of Hypothetical New Peptides Based on a Cyclotide Scaffold as HIV gp120 Inhibitor. PLOS One 10, e0139562 (2015).
Sansone, et al. Targeting the interleukin-6/jak/stat pathway in human malignancies. J. Clin. Oncol. 30, 1005-1014 (2012).

(56) References Cited

OTHER PUBLICATIONS

Santos, et al. Thermofluor-based optimization strategy for the stabilization and crystallization of Campylobacter jejuni desulforubrerythrin. Protein Expr. Purif. 81, 193-200 (2012).
Schlee et al. Recognition of 5' triphosphate by RIG-I helicase requires short blunt double-stranded RNA as contained in panhandle of negative-strand virus. Immunity. Jul. 17, 2009;31(1):25-34. With Supplemental Data Sheet (8 pages).
Schmidt, et al. 5'-triphosphate RNA requires base-paired structures to activate antiviral signaling via RIG-I. Proceedings of the National Academy of Sciences 106 (2009): 12067-72.
Schwartz, et al. Characterization of hadrucalcin, a peptide from Hadrurus gertschi scorpion venom with pharmacological activity on ryanodine receptors. Br J Pharmacol. Jun. 2009; 157(3):392-403.
Sellers, Peter H. On the theory and computation of evolutionary distances. SIAM Journal on Applied Mathematics. 1974;26:787.
Shahbazzadeh, et al. Hemicalcin, a new toxin from the Iranian scorpion *Hemiscorpius lepturus* which is active on ryanodine-sensitive Ca2+ channels. Biochem. J. 404, 89-96 (2007).
Shire, et al. Challenges in the development of high protein concentration formulations. Journal of pharmaceutical sciences 93.6 (2004): 1390-1402.
Sillero et al. Isoelectric point determination of proteins and other macromolecules: oscillating method. Comput Biol Med. Feb. 2006;36(2):157-66. Epub Jan. 1, 2005.
Sillero et al. Isoelectric points of proteins: theoretical determination. Anal Biochem. Jun. 1989;179(2):319-25.
Simeon, Rudo et al., In vitro-engineered non-antibody protein therapeutics, Protein Cell 218, 9(1);3-14.
Singh, et al. Antibody-Drug Conjugates: Design, Formulation and Physicochemical Stability. Pharm Res. Nov. 2015;32(11):3541-71.
Sinha, et al. Oral colon-specific drug delivery of protein and peptide drugs. Crit Rev Ther Drug Carrier Syst. 2007;24(1):63-92.
Sinniah, R. et al., Serum iron, total iron-binding capacity, and percentage saturation in normal subjects. J. Clin. Pathol. 21, 603-10 (1968).
Solon, E.G. Autoradiography techniques and quantification of drug distribution. 2015 Cell Tiss. Res. 360(1): 87-107.
Soroceanu, et al. Use of chlorotoxin for targeting of primary brain tumors. Cancer Res. Nov. 1, 1998;58(21):4871-9.
Sottero et al. Pacifastin-derived Peptides Target Tumors for Use in In Vivo Imaging. Anticancer Res. Jan. 2018;38(1):51-60.
Stern, et al. Alternative non-antibody protein scaffolds for molecular imaging of cancer. Current opinion in chemical engineering 2.4 (2013): 425-432.
Sudo, et al. Human-derived fusogenic peptides for the intracellular delivery of proteins. J. Control. Release 255, 1-11 (2017).
Sutherland, R. et al. Ubiquitous cell-surface glycoprotein on tumor cells is proliferation-associated receptor for transferrin. Proc. Natl. Acad. Sci. U. S. A. 78, 4515-9 (1981).
Tabrizi, et al., Biodistribution mechanisms of therapeutic monoclonal antibodies in health and disease. AAPS J. 12, 33-43 (2010).
Tait, et al. Die another way—non-apoptotic mechanisms of cell death. J Cell Sci. May 15, 2014;127(Pt 10):2135-44. doi: 10.1242/jcs.093575.
Takayama, et al. Enhanced intracellular delivery using arginine-rich peptides by the addition of penetration accelerating sequences (Pas). J. Control. Release 138, 128-133 (2009).
Tam, et al., Antimicrobial peptides from plants. Pharmaceuticals 8, 711-757 (2015).
Tangri, et al. Rationally engineered proteins or antibodies with absent or reduced immunogenicity. Curr. Med. Chem. 9, 2191-9 (2002).
Tesmer, J. J., et al. The structure, catalytic mechanism and regulation of adenylyl cyclase. Curr. Opin. Struct. Biol. 8, 713-719 (1998).
The UniProt Consortium. UniProt: The Universal Protein Knowledgebase. Nucleic Acids Research, 2017, 45, D158-D169. Published online Nov. 11, 2016.
Trenevska, I., et al., Therapeutic Antibodies against Intracellular Tumor Antigens. Front. Immunol. 8, 1001 (2017).
Trudeau, L. E. Neurotensin regulates intracellular calcium in ventral tegmental area astrocytes: Evidence for the involvement of multiple receptors. Neuroscience 97, 293-302 (2000).
Tsunemi, et al. Crystallization of a complex between an elastase-specific inhibitor elafin and porcine pancreatic elastase. J. Mol. Biol. 232, 310-1 (1993).
Tundo, et al. Effect of cisplatin on proteasome activity. J Inorg Biochem. Dec. 2015;153:253-258. doi: 10.1016/j.jinorgbio.2015.08.027. Epub Sep. 4, 2015.
U.S. Appl. No. 15/739,669 Office Action dated May 14, 2020.
U.S. Appl. No. 15/758,320 Office Action dated Apr. 15, 2020.
U.S. Appl. No. 15/739,669 Office Action dated Nov. 27, 2019.
U.S. Appl. No. 15/758,320 Office Action dated Feb. 26, 2019.
U.S. Appl. No. 15/758,320 Office Action dated Jul. 25, 2019.
Vargas et al. Rationale for stimulator of interferon genes-targeted cancer immunotherapy. Eur J Cancer. Apr. 2017;75:86-97.
Vasalou, et al. A Mechanistic Tumor Penetration Model to Guide Antibody Drug Conjugate Design. PLOS One, Mar. 2015; 10(3): e0118977, 1-20.
Veiseh, et al. Tumor paint: a chlorotoxin:Cy5.5 bioconjugate for intraoperative visualization of cancer foci. Cancer Res. Jul. 15, 2007;67(14):6882-8.
Vinay et al. 4-1BB (CD137), an inducible costimulatory receptor, as a specific target for cancer therapy. BMB Rep. Mar. 2014; 47(3): 122-129.
Vincent et al., Neurotensin and neurotensin receptors. Trends Pharmacol. Sci. 20, 302-309 (1999).
Vitt, et al. Evolution and classification of cystine knot-containing hormones and related extracellular signaling molecules. Molecular endocrinology15.5 (2001): 681-694.
Vives, et al. A Truncated HIV-1 Tat Protein Basic Domain Rapidly Translocates Through the Plasma Membrane and Accumulates in the Cell Nucleus. J. Biol. Chem. 1997 272(25):16010-16017.
Vordenbaumen, et al. Defensins potential effectors autoimmune rheumatic disorders. Polymers. 2011; 3:1268-1281.
Wakankar, et al. Formulation considerations for proteins susceptible to asparagine deamidation and aspartate isomerization. Journal of pharmaceutical sciences 95.11 (2006): 2321-2336.
Wang, X. et al. Characterization of promoter elements regulating the expression of the human neurotensin/neuromedin N gene. J. Biol. Chem. 286, 542-554 (2011).
Weatherall, et al. Small conductance calcium-activated potassium channels: from structure to function. Prog Neurobiol. Jul. 2010;91(3):242-55. doi: 10.1016/j.pneurobio.2010.03.002. Epub Mar. 30, 2010.
Werle, et al. The potential of cystine-knot microproteins as novel pharmacophoric scaffolds in oral peptide drug delivery. J. Drug Targeting 2006; 14:137-146.
Winn, et al. Overview of the CCP4 suite and current developments. Acta Crystallographica Section D 67.4 (2011): 235-242.
Winnard, et al. Development of novel chimeric transmembrane proteins for multimodality imaging of cancer cells. Cancer Biol. Ther. 6, 1889-99 (2007).
Wiranowska, et al. Clathrin-mediated entry and cellular localization of chlorotoxin in human glioma. Cancer Cell Int. Aug. 12, 2011;11:27.
Wischnjow, et al. Renal Targeting: Peptide-Based Drug Delivery to Proximal Tubule Cells. Bioconjug Chem. Apr. 20, 2016;27(4):1050-7. doi: 10.1021/acs.bioconjchem.6b00057. Epub Mar. 30, 2016.
Yamada, et al. Internalization of bacterial redox protein azurin in mammalian cells: Entry domain and specificity. Cell. Microbiol. 7, 1418-1431 (2005).
Yang, et al. Protein-peptide interactions analyzed with the yeast two-hybrid system. Nucleic Acids Res. 23, 1152-1156 (1995).
Yang, J et al. The I-TASSER Suite: protein structure and function prediction. Nat. Methods 12, 7-8 (2015).
Ye, et al. The scorpion toxin analogue BmKTX-D33H as a potential Kv1.3 channel-selective immunomodulator for autoimmune diseases. Toxins 8.4 (2016): 115.
Yurkovetskiy, et al. A Polymer-Based Antibody-Vinca Drug Conjugate Platform: Characterization and Preclinical Efficacy. Cancer Res. Aug. 15, 2015;75(16):3365-72.

(56) References Cited

OTHER PUBLICATIONS

Zhang, et al. Tumor-selective proteotoxicity of verteporfin inhibits colon cancer progression independently of YAP1. Sci. Signal. 8, ra98 (2015).

Zhao, et al. Chemical engineering of cell penetrating antibodies. J. Immunol. Methods 254, 137-145 (2001).

Zhou, et al. Kidney-targeted drug delivery systems. Acta Pharm Sin B. Feb. 2014; 4(1): 37-42. Published online Jan. 23, 2014. doi: 10.1016/j.apsb.2013.12.005.

Zhu, et al. Evolutionary origin of inhibitor cystine knot peptides. FASEB J. 17, 1765-1767 (2003).

Zhu, et al. Novel Human Interleukin-15 Agonists. J Immunol Sep. 15, 2009, 183 (6) 3598-3607.

Zhu et al. Precursor nucleotide sequence and genomic organization of BmTXKS1, a new scorpion toxin-like peptide from Buthus martensii Karsch. Toxicon. Sep. 2001;39(9):1291-6.

Chen S., et al., "A Targeted IL-15 Fusion Protein with Potent Anti-tumor activity," Cancer biology & therapy, Sep. 2015, vol. 16 (8), pp. 1415-1421.

Debin J. A., et al., "Purification and Characterization of Chlorotoxin, A Chloride Channel Ligand from the Venom of the Scorpion," American Journal of Physiology, Feb. 1993, vol. 264 (2 Pt 1), pp. C361-C369.

Fiveash J.B., et al., "Tumor Specific Targeting of Intravenous 131I-chlorotoxin (TM-601) in Patients With Recurrent Glioma," International Journal of Radiation Oncology, ASTRO. Nov. 1, 2007, vol. 69, Issue. 3, Supplement, pp. S257-S258.

Huys I., et al., "Structure-Function Study of a Chlorotoxin-Chimer and its Activity on Kv1.3 Channels," J. Chromatogr., 803:67-73 (Apr. 15, 2004).

Jacoby D.B., et al., "Potent Pleiotropic Anti-Angiogenic Effects of CTX, a Synthetic Chlorotoxin Peptide," Anticancer Res., 30:39-46 (2010).

Lyons S.A., et al., "Chlorotoxin, A Scorpion-Derived Peptide, Specifically Binds to Gliomas and Tumors of Neuroectodermal Origin," Glia, 39:162-173 (2002).

McGonigle S., et al., "Neuropilin-1 Drives Tumor-Specific Uptake of Chlorotoxin," Cell Communication and Signaling, Jun. 17, 2019, vol. 17, No. 1, 67, 14 pages.

Silva R.L.E., et al., "Agents that Bind Annexin A2 Suppress Ocular Neovascularization," J Cell Physiol., 225(3):855-64 (2010).

European Patent Application No. 18891429.5 Extended European Search Report dated Sep. 3, 2021.

Kermer et al., An antibody fusion protein for cancer immunotherapy mimicking IL-15 trans-presentation at the tumor site. Mol Cancer There 11(6):1279-88 (2012).

Ochoa et al., Antitumor immunotherapeutic and toxic properties of an HDL-conjugated chimeric IL-15 fusion protein. Cancer Res 73(1):139-49 (2013).

Suthaus et al., Forced homo- and heterodimerization of all gp130-type receptor complexes leads to constitutive ligand-independent signaling and cytokine-independent growth. Mol Biol Cell 21(15):2797-807 (2010).

\* cited by examiner

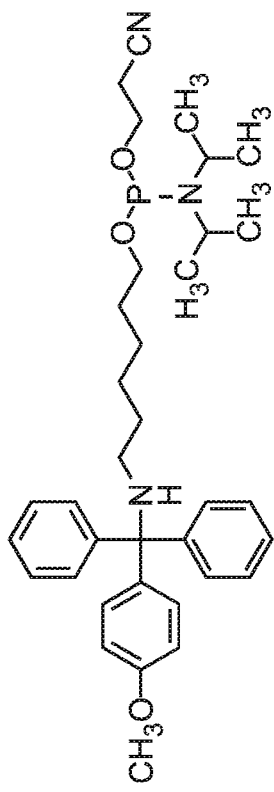
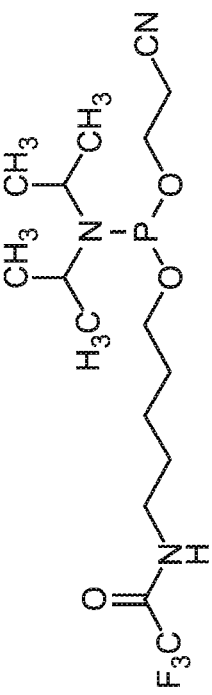
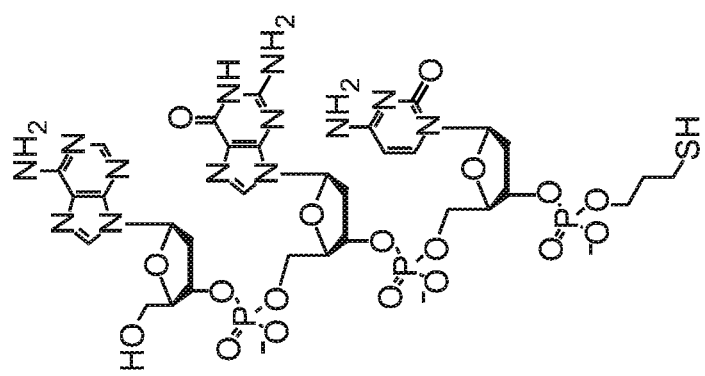
FIG. 1B
FIG. 1C
FIG. 1A
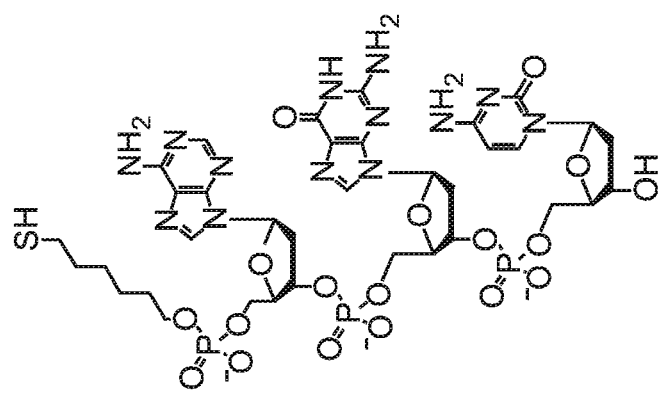

2'-(2-mercaptoethoxy)-2'-deoxy-RNA "tethered thiol"

2'-(2-aminoethoxy)-2'-deoxy-RNA "tethered amine"

3'-aminohexyl

5'-aminohexyl

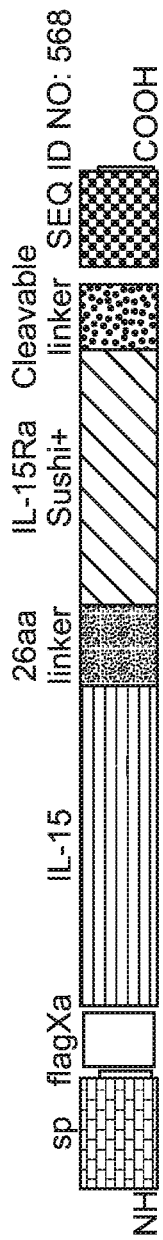
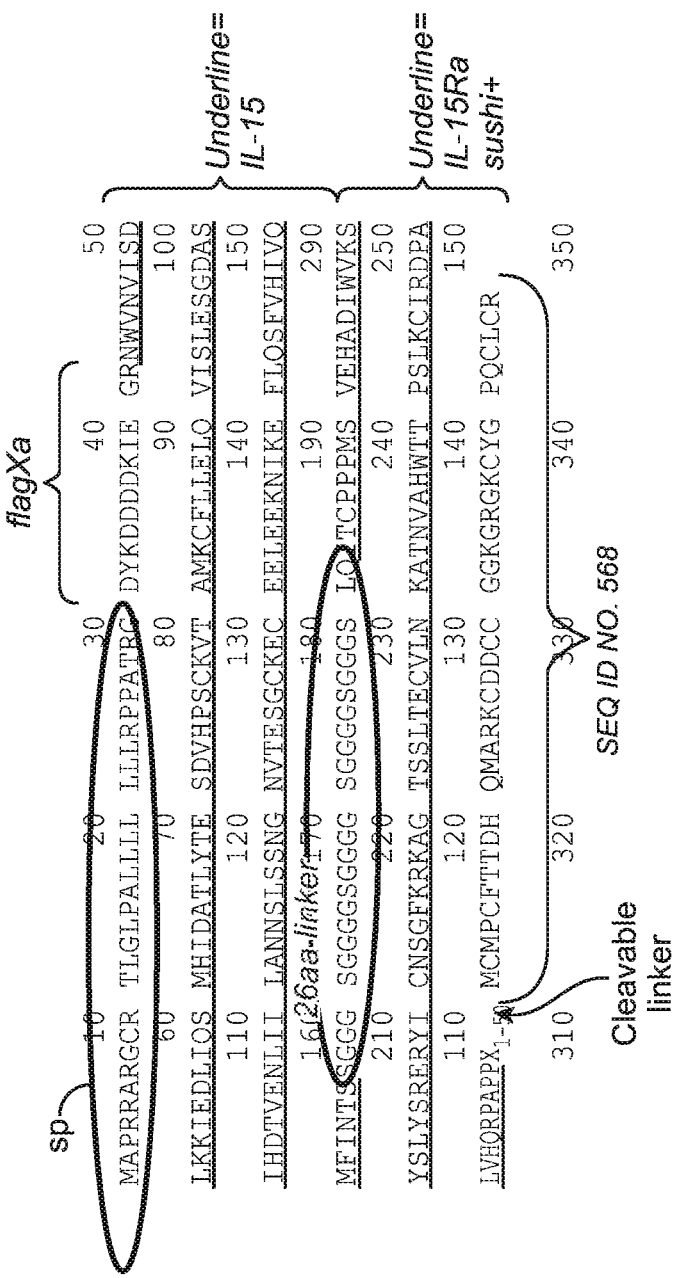
FIG. 4A
FIG. 4B

Dispiro diketopiperzine
(DSDP)

ML-RR-S2-CDA

ML-RS-S2-CDA

```
                                                    C
                                               UC  A  UCCU
                                     U U U    UC UU A UUG GU
                           ACA       U        UC UU A UUG GU CA
5'                                                              U    C
pppAGUAGAA   AGGGUA        AG U GAGUAGU       U            UGUAGU
   UCGUUUU   UCCCAU        C  A
3'            C  G          U  U
```

Influenza A genome (segment 5; NC_002019)

FIG. 14

```
                                    ACUACAC
                                   G
              A  G    ACGA
5'pppACCAAACA  AAGAUUUGGUGA      UGCU   A
3'  UGGUUUG  UCUUAGCCACU   CAA  A UUUUCG
```

FIG. 15

NDV genome (NC_002617)

SEQ ID NO: 1371
Extended Stable Linker (-OH)
Peptide: seq id no 568
mw: 16678

SEQ ID NO: 1371
Extended Stable Linker
Peptide: SEQ ID NO 569
mw: 16717

SEQ ID NO: 1371
Extended Stable Linker (-OH)
Peptide: peptide complex of Fig. 27
mw: 17448

SEQ ID NO: 1371

Cleavable Disulfide/PEG Linker
Peptide: SEQ ID NO: 569

SEQ ID NO: 1371
Cleavable Hydrazone Linker
Peptide: SEQ ID NO: 569

SEQ ID NO: 1371

Cleavable Long Disulfide Linker
Peptide: SEQ ID NO: 569

SEQ ID NO: 1371

Cleavable Short Disulfide Linker
Peptide: SEQ ID NO: 569

SEQ ID NO: 1375
Extended Stable Linker
RNA: 24mer
Peptide: SEQ ID NO: 568

SEQ ID NO: 1375
Extended Stable Linker
RNA: 24mer
Peptide: SEQ ID NO: 569

SEQ ID NO: 1375
Extended Stable Linker
RNA: 24mer
Peptide: SEQ ID NO: 570

SEQ ID NO: 1376
Extended Stable Linker
RNA: 32mer
Peptide: SEQ ID NO: 568

SEQ ID NO: 1376
Extended Stable Linker
RNA: 32mer
Peptide: SEQ ID NO: 570

SEQ ID NO:1371

Extended Stable Linker
RNA: 38mer
Peptide: SEQ ID NO: 568

SEQ ID NO:1371

Extended Stable Linker
RNA: 38mer
Peptide: SEQ ID NO: 569

SEQ ID NO:1371

Extended Stable Linker
RNA: 38mer
Peptide: SEQ ID NO: 570

SEQ ID NO: 1376

Extended Stable Linker
RNA: 32mer (Diphosphate)
Peptide: SEQ ID NO: 568

SEQ ID NO:1376

Extended Stable Linker
RNA: 32mer (Diphosphate)
Peptide: SEQ ID NO: 569

SEQ ID NO:1376

Extended Stable Linker
RNA: 32mer (Diphosphate)
Peptide: SEQ ID NO: 570

SEQ ID NO:1426 (sense)
5'-pppGGACGUACGUUCGCGACUGUAGA-O
3'-CCUGCAUGCAAAGCGCUGACAUCU-5'
SEQ ID NO:1427 (antisense)

Extended Stable Linker
RNA: 24mer (Double Strand)
Peptide: SEQ ID NO: 568

SEQ ID NO:1426 (sense)

5'-pppGGACGUACGUUUCGCGACUGUAGA-O
3'-CCUGCAUGCAAAGCGCUGACAUCU-5'

SEQ ID NO:1427 (antisense)

Extended Stable Linker
RNA: 24mer (Double Strand)
Peptide: SEQ ID NO: 569

SEQ ID NO:1426 (sense)

5'-pppGGACGUACGUUCGCGACUGUAGA-O
3'-CCUGCAUGCAAAGCGCUGACAUCU-5'

SEQ ID NO:1427 (antisense)

Extended Stable Linker
RNA: 24mer (Double Strand)
Peptide: SEQ ID NO: 570

SEQ ID NO:1424 (sense)
5'-pppGCAUGCGACCUCUGUUUGA-O
3'-CGUACGCUGGAGACAAACU-5'
SEQ ID NO:1425 (antisense)

Extended Stable Linker
RNA: 19mer (Double Strand)
Peptide: SEQ ID NO: 568

SEQ ID NO:1424 (sense)
5'-pppGCAUGGACCUCUGUUUGA-O
3'-CGUACGCUGGAGACAAACU-5'
SEQ ID NO:1425 (antisense)

Extended Stable Linker
RNA: 19mer (Double Strand)
Peptide: SEQ ID NO: 569

SEQ ID NO:1424 (sense)
5'-pppGCAUGCGACCUCUGUUUGA-O
3'-CGUACGCUGGAGACAAACU-5'
SEQ ID NO:1425 (antisense)

Extended Stable Linker
RNA: 19mer (Double Strand)
Peptide: SEQ ID NO: 570

SEQ ID NO:1379

Extended Stable Linker
RNA: 52mer
Peptide: SEQ ID NO: 568

SEQ ID NO:1379

Extended Stable Linker
RNA: 52mer
Peptide: SEQ ID NO: 569

SEQ ID NO:1379

Extended Stable Linker
RNA: 52mer
Peptide: SEQ ID NO: 570

5'-pppG*C*AUGCGACCUCUGUUUGA—O
SEQ ID NO:1371

—O—CAAACAGAGGUCGCAU*G*C—3'

Extended Stable Linker
RNA: 38mer
Peptide: SEQ ID NO: 569
*= phosphorothioate linkage

SEQ ID NO:1371

Extended Stable Linker
RNA: 38mer
Peptide: SEQ ID NO: 569
*= phosphorothioate linkage
f= 2' Fluoro RNA

SEQ ID NO:1371

Extended Stable Linker
RNA: 38mer
Peptide: SEQ ID NO: 569
*= phosphorothioate linkage
f= 2' Fluoro RNA

SEQ ID NO:1371

Extended Stable Linker
RNA: 38mer
Peptide: SEQ ID NO: 569
* = phosphorothioate linkage
+ = BNA/LNA 5'ppp dsRNA= SEQ ID NO: 1424 sense and SEQ ID NO: 1425 antisense, with 5'ppp on sense
5'ppp hpRNA = SEQ ID NO: 1371

TUMOR HOMING AND CELL PENETRATING PEPTIDE-IMMUNO-ONCOLOGY AGENT COMPLEXES AND METHODS OF USE THEREOF

CROSS-REFERENCE

This application is a 371 U.S. National Stage entry of International Application No. PCT/US2018/066337, filed Dec. 18, 2018, which claims the benefit of U.S. Provisional Application No. 62/607,893 filed Dec. 19, 2017, and U.S. Provisional Application No. 62/622,711 filed Jan. 26, 2018, all of which are incorporated herein by reference in their entireties for all purposes.

SEQUENCE LISTING

The instant application contains a Sequence Listing which has been submitted electronically in ASCII format and is hereby incorporated by reference in its entirety. Said ASCII copy, created on Dec. 18, 2018, is named 45639-715_601_SL.txt and is 1,042,425 bytes in size.

BACKGROUND

Cancer therapy has faced numerous challenges with respect to the specificity and selectivity of a given treatment for eradicating tumor cells. In particular, drugs that can stimulate host immune activity against cancer cells suffer from a lack of specificity when systemically delivered, which can lead to off-target effects against healthy cells. In addition, other drugs that can stimulate host immune activity may not efficiently reach their site of action (such as in the cell cytoplasm, or across the blood brain barrier). Thus, a significant problem that remains in the field is targeted delivery of immuno-oncology agents to the tumor microenvironment, uptake of immuno-oncology agents in appropriate intracellular compartments in tumor cells, and delivery of immuno-oncology agents to inaccessible tumor sites, such as the brain. Herein, we provide peptides with tumor homing, cell penetration, and/or blood-brain barrier traversing properties, which can be coupled to immuno-oncology agents for cancer therapy.

SUMMARY

In various aspects, the present disclosure provides a composition comprising a peptide-immuno-oncology agent complex (peptide-I/O complex), wherein the peptide of the peptide-I/O complex is tumor-homing; and wherein the immuno-oncology agent (I/O) of the peptide-I/O complex is an IL-15 agent, a RIG-I ligand, a 4-1BB ligand, a STING ligand, an MDA5 ligand, a CGAS ligand, a TLR3 ligand, a TLR7/8 ligand, or a TLR9 ligand.

In various aspects, the present disclosure provides a composition comprising a peptide-immuno-oncology agent complex (peptide-I/O complex), wherein the peptide of the peptide-I/O complex is cell penetrating; and wherein the immuno-oncology agent (I/O) of the peptide-I/O complex is an IL-15 agent, a RIG-I ligand, a 4-1BB ligand, a STING ligand, an MDA5 ligand, a CGAS ligand, a TLR3 ligand, a TLR7/8 ligand, or a TLR9 ligand.

In various aspects, the present disclosure provides a composition comprising a peptide-immuno-oncology agent complex (peptide-I/O complex), wherein the peptide of the peptide-I/O complex is blood brain barrier (BBB) penetrating; and wherein the immuno-oncology agent (I/O) of the peptide-I/O complex is an IL-15 agent, a RIG-I ligand, a 4-1BB ligand, a STING ligand, an MDA5 ligand, a CGAS ligand, a TLR3 ligand, a TLR7/8 ligand, or a TLR9 ligand. In some aspects, the I/O comprises an agonist of a receptor, wherein the receptor comprises IL-15R, RIG-I, 4-1BB, STING, MDA5, CGAS, TLR3, TLR7/8, or TLR9.

In various aspects, the present disclosure provides a composition comprising a peptide-immuno-oncology agent complex (peptide-I/O complex), the peptide-I/O complex comprising a) a peptide, wherein the peptide of the peptide-I/O complex is a tumor-homing peptide comprising a sequence that has at least 70%, at least 75%, at least 80%, at least 85%, at least 90%, at least 91%, at least 92%, at least 93%, at least 94%, at least 95%, at least 96%, at least 97%, at least 98%, at least 99%, or at least 100% sequence identity with any one of SEQ ID NO: 1-SEQ ID NO: 567, SEQ ID NO: 1243-SEQ ID NO: 1252, SEQ ID NO: 1263-SEQ ID NO: 1289, wherein upon administration to a subject the peptide homes, targets, migrates to, accumulates in, binds to, is retained by, is processed by, or is directed to a tumor of the subject; and b) an immuno-oncology agent (I/O), wherein the I/O of the peptide-I/O complex stimulates a host immune response against the tumor.

In various aspects, the present disclosure provides a composition comprising a peptide-immuno-oncology agent complex (peptide-I/O complex), the peptide-I/O complex comprising a) a peptide, wherein the peptide of the peptide-I/O complex is a tumor-homing peptide comprising a sequence that has at least 70%, at least 75%, at least 80%, at least 85%, at least 90%, at least 91%, at least 92%, at least 93%, at least 94%, at least 95%, at least 96%, at least 97%, at least 98%, at least 99%, or at least 100% sequence identity with any one of SEQ ID NO: 568-SEQ ID NO: 1134, SEQ ID NO: 1253-SEQ ID NO: 1262, SEQ ID NO: 1290-SEQ ID NO: 1316, wherein upon administration to a subject the peptide homes, targets, migrates to, accumulates in, binds to, is retained by, is processed by, or is directed to a tumor of the subject; and b) an immuno-oncology agent (I/O), wherein the I/O of the peptide-I/O complex stimulates a host immune response against the tumor.

In various aspects, the present disclosure provides a composition comprising a peptide-immuno-oncology agent complex (peptide-I/O complex), the peptide-I/O complex comprising a) a peptide, wherein the peptide of the peptide-I/O complex is a cell penetrating peptide comprising a sequence that has at least 70%, at least 75%, at least 80%, at least 85%, at least 90%, at least 91%, at least 92%, at least 93%, at least 94%, at least 95%, at least 96%, at least 97%, at least 98%, at least 98%, or at least 100% sequence identity with any one of SEQ ID NO: 1-SEQ ID NO: 567, SEQ ID NO: 1243-SEQ ID NO: 1252, or SEQ ID NO: 1263-SEQ ID NO: 1289, is cell penetrating; and b) an immuno-oncology agent (I/O), wherein the I/O of the peptide-I/O complex stimulates a host immune response against the tumor.

In various aspects, the present disclosure provides a composition comprising a peptide-immuno-oncology agent complex (peptide-I/O complex), the peptide-I/O complex comprising: a) a peptide, wherein the peptide of the peptide-I/O complex is a cell penetrating peptide comprising a sequence that has at least 70%, at least 75%, at least 80%, at least 85%, at least 90%, at least 91%, at least 92%, at least 93%, at least 94%, at least 95%, at least 96%, at least 97%, at least 98%, at least 98%, or at least 100% sequence identity with any one of SEQ ID NO: 568-SEQ ID NO: 1134, SEQ ID NO: 1253-SEQ ID NO: 1262, or SEQ ID NO: 1290-SEQ ID NO: 1316, wherein upon administration to a subject the peptide is cell penetrating; and b) an immuno-oncology agent (I/O), wherein the I/O of the peptide-I/O complex stimulates a host immune response against the tumor.

In various aspects, the present disclosure provides a composition comprising a peptide-immuno-oncology agent complex (peptide-I/O complex), the peptide-I/O complex comprising: a) a peptide, wherein the peptide of the peptide-I/O complex is a blood brain barrier (BBB) penetrating peptide comprising a sequence that has at least 70%, at least 75%, at least 80%, at least 85%, at least 90%, at least 91%, at least 92%, at least 93%, at least 94%, at least 95%, at least 96%, at least 97%, at least 98%, at least 98%, or at least 100% sequence identity with any one of SEQ ID NO: 1-SEQ ID NO: 567, SEQ ID NO: 1243-SEQ ID NO: 1252, or SEQ ID NO: 1263-SEQ ID NO: 1289, wherein upon administration to a subject the peptide is blood brain barrier (BBB) penetrating; and b) an immuno-oncology agent (I/O), wherein the I/O of the peptide-I/O complex stimulates a host immune response against the tumor.

In various aspects, the present disclosure provides a composition comprising a peptide-immuno-oncology agent complex (peptide-I/O complex), the peptide-I/O complex comprising a) a peptide, wherein the peptide of the peptide-I/O complex is a blood brain barrier (BBB) penetrating peptide comprising a sequence that has at least 70%, at least 75%, at least 80%, at least 85%, at least 90%, at least 91%, at least 92%, at least 93%, at least 94%, at least 95%, at least 96%, at least 97%, at least 98%, at least 98%, or at least 100% sequence identity with any one of SEQ ID NO: 568-SEQ ID NO: 1134, SEQ ID NO: 1253-SEQ ID NO: 1262, or SEQ ID NO: 1290-SEQ ID NO: 1316, wherein upon administration to a subject the peptide is blood brain barrier (BBB) penetrating; and b) an immuno-oncology agent (I/O), wherein the I/O of the peptide-I/O complex stimulates a host immune response against the tumor.

In some aspects, the I/O comprises an IL-15 agent, a RIG-I ligand, a 4-1BB ligand, a STING ligand, an MDA5 ligand, a CGAS ligand, a TLR3 ligand, a TLR7/8 ligand, or a TLR9 ligand.

In some aspects, the I/O comprises an agonist of a receptor or target, wherein the receptor or target comprises IL-15R, RIG-I, 4-1BB, STING, MDA5, CGAS, TLR, TLR7/8, or TLR9.

In some aspects, the peptide comprises tumor homing properties. In some aspects, the peptide comprises a cell penetrating property. In some aspects, the cell penetrating property comprises uptake into an endosome; uptake into a subcellular compartment; uptake and processing in a subcellular compartment and secretion; uptake and delivery to cytoplasm; uptake and transcytosis; uptake and nuclear localization; uptake and extracellular presentation; pinocytosis; uptake, cleavage, and secretion into the tumor microenvironment; or uptake and presentation on a cell surface protein. In some aspects, the peptide-I/O complex targets the cytosol. In some aspects, the peptide-I/O complex is taken up, processed, and presented extracellularly.

In some aspects, the peptide-I/O complex enters, accumulates in, or is processed in a cellular compartment, wherein the cellular compartment comprises a subcellular compartment, cytoplasm, endoplasmic reticulum, Golgi apparatus, endosome, or lysosome. In some aspects, the peptide homes to, targets, migrates to, accumulates in, binds to, is retained by, is processed by, or is directed to a tumor of the subject. In some aspects, the peptide is cleaved from the peptide-I/O complex in a tumor cell environment, within a cell, in an endosome, in a lysosome, in cytosol, in endoplasmic reticulum, or in Golgi apparatus.

In some aspects, the peptide crosses the blood brain barrier (BBB). In some aspects, the peptide-I/O complex, the peptide, the I/O, or any combination thereof enters the cell cytosol, a subcellular compartment, endoplasmic reticulum, Golgi apparatus, endosome, lysosome. In some aspects, the I/O stimulates immunogenic cell death (ICD). In some aspects, the peptide-I/O complex is processed by a cell or a tumor microenvironment. In some aspects, the processing of the peptide-I/O complex by the cell or tumor microenvironment changes activity, concentration, method or location of presentation of the peptide-I/O complex.

In some aspects, the IL-15 agent comprises an IL-15 hyperagonist. In some aspects, the IL-15 agent comprises a fusion of an IL-15 domain and an IL-15Rα sushi+ domain.

In some aspects, the IL-15 agent comprises the following formula: $L_0$-X-$L_1$-Y-$L_2$, wherein any one of X, Y, comprises SEQ ID NO: 1177 or SEQ ID NO: 1178 or SEQ ID NO: 1491, wherein any one of X, Y, comprises SEQ ID NO: 1176 or SEQ ID NO: 1179, and wherein $L_0$, $L_1$, $L_2$, comprises any one of SEQ ID NO: 1163-SEQ ID NO: 1172 or SEQ ID NO: 1359-SEQ ID NO: 1366 or SEQ ID NO: 1139-SEQ ID NO: 1161 or $L_0$, $L_1$, $L_2$, comprises Xn, wherein each X individually comprises any amino acid and n is any number from 1 to 50 or are absent.

In some aspects, the IL-15 agent comprises two moieties of SEQ ID NO: 1177 and a moiety of SEQ ID NO: 1179. In some aspects, the IL-15 agent comprises two moieties of SEQ ID NO: 1178 and a moiety of SEQ ID NO: 1179. In some aspects, the IL-15 agent is selected from TABLE 3. In some aspects, the peptide-IL-15 agent is selected from SEQ ID NO: 1317-SEQ ID NO: 1341, and SEQ ID NO: 1343-SEQ ID NO: 1348. In some aspects, the IL-15 agent is selected from $L_0$-X-$L_1$-Y-$L_2$ wherein $L_1$ can be SEQ ID NO: 1169 or SEQ ID NO: 1163, X can be SEQ ID NO: 1176 or SEQ ID NO: 1179, and Y can be SEQ ID NO: 1177, SEQ ID NO: 1178, in any combination. In some aspects, the peptide-I/O complex is selected from TABLE 4.

In some aspects, the RIG-I ligand comprises a double stranded RNA (dsRNA). In some aspects, the RIG-I ligand comprises hairpin RNA. In some aspects, the MDA5 ligand comprises a double stranded RNA (dsRNA). In some aspects, the MDA5 ligand comprises hairpin RNA. In some aspects, the dsRNA comprises 10-60 base pairs. In some aspects, the dsRNA comprises 11-18 base pairs. In some aspects, the dsRNA comprises 7-10 base pairs. In some aspects, the dsRNA comprises a hairpin RNA. In some aspects, the hairpin RNA comprises 14-120 base pairs. In some aspects, the hairpin RNA comprises 7-60 base pairs. In some aspects, at least one base pair in the single hairpin RNA comprises a first base paired with a second base within the hairpin RNA. In some aspects, the hairpin RNA comprises a 5' triphosphate. In some aspects, the hairpin RNA is a single hairpin RNA. In some aspects, the RIG-I ligand comprises a 5' triphosphate. In some aspects, the RIG-I ligand comprises a 5' diphosphate. In some aspects, the RIG-I ligand comprises an uncapped 5'A or G. In some aspects, the RIG-I ligand comprises a 5' triphosphate on a blunt end. In some aspects, the RIG-I ligand comprises a panhandle region in a negative-strand RNA virus.

In some aspects, the RIG-I ligand comprises a benzobisthiazole compound. In some aspects, an RNA backbone of the RIG-I ligand comprises a modification for increased in vivo stability compared to an unmodified RNA backbone of the RIG-I ligand. In some aspects, the modification comprises a 2'-fluoro-modification, a phosphorothioate-substitution, a methyl phosphonate modification, a 2'-O methyl modification, a 2'-F RNA base, a bridged nucleic acid, a morpholino nucleic acid, a PNA, an LNA, an ethyl cEt nucleic acid or any combination thereof. In some aspects, the RIG-I ligand forms its own double strand. In some aspects, the RIG-I ligand is selected from TABLE 6.

In some aspects, the RIG-I ligand is SEQ ID NO: 1180 and SEQ ID NO: 1181, SEQ ID NO: 1182 and SEQ ID NO: 1183, SEQ ID NO: 1184 and SEQ ID NO: 1185, SEQ ID NO: 1186 and SEQ ID NO: 1187, SEQ ID NO: 1189 and SEQ ID NO: 1190, SEQ ID NO: 1191 and SEQ ID NO: 1192, SEQ ID NO: 1203 and SEQ ID NO: 1204, SEQ ID NO: 1205 and SEQ ID NO: 1206, SEQ ID NO: 1235 and SEQ ID NO: 1236, SEQ ID NO: 1237 and SEQ ID NO: 1238, SEQ ID NO: 1239 and SEQ ID NO: 1240, and SEQ ID NO: 1241 and SEQ ID NO: 1242. In some aspects, SEQ ID NO: 1189, SEQ ID NO: 1191, SEQ ID NO: 1196, or SEQ ID NO: 1198 comprises a triphosphate on the 5' end of a sense strand. In some aspects, SEQ ID NO: 1196 does not comprise a triphosphate. In some aspects, SEQ ID NO: 1180-SEQ ID NO: 1187 comprises a 5' triphosphate group. In some aspects, the RIG-I ligand is SEQ ID NO: 1371.

In some aspects, the MDA5 ligand comprises an uncapped 5'A or G. In some aspects, the MDA5 ligand comprises a panhandle region in a negative-strand RNA virus. In some aspects, the MDA5 ligand comprises a benzobisthiazole compound. In some aspects, an RNA backbone of the MDA5 ligand comprises a modification for increased in vitro or in vivo stability compared to an unmodified RNA backbone of the MDA5 ligand.

In some aspects, the modification comprises a 2'-fluoro-modification, a phosphorothioate-substitution, a methyl phosphonate modification, a 2'-O methyl modification, a 2'-F RNA base, a bridged nucleic acid, a morpholino nucleic acid, a PNA, an LNA, an ethyl cEt nucleic acid or any combination thereof. In some aspects, the MDA5 ligand forms its own double strand. In some aspects, the MDA5 ligand is selected from TABLE 6. In some aspects, the MDA5 ligand is SEQ ID NO: 1180 and SEQ ID NO: 1181, SEQ ID NO: 1182 and SEQ ID NO: 1183, SEQ ID NO: 1184 and SEQ ID NO: 1185, SEQ ID NO: 1186 and SEQ ID NO: 1187, SEQ ID NO: 1189 and SEQ ID NO: 1190, SEQ ID NO: 1191 and SEQ ID NO: 1192, SEQ ID NO: 1203 and SEQ ID NO: 1204, SEQ ID NO: 1205 and SEQ ID NO: 1206, SEQ ID NO: 1235 and SEQ ID NO: 1236, SEQ ID NO: 1237 and SEQ ID NO: 1238, SEQ ID NO: 1239 and SEQ ID NO: 1240, and SEQ ID NO: 1241 and SEQ ID NO: 1242, and SEQ ID NO: 1193, and SEQ ID NO: 1194, and SEQ ID NO: 1195, and SEQ ID NO: 1196, and SEQ ID NO: 1197, and SEQ ID NO: 1198, and SEQ ID NO: 1200.

In some aspects, the MDA5 ligand does not comprise one or more of a 5' triphosphate, 5'diphosphate, 5' monophosphate, and 5' cap of ribose 2'-O-methylation. In some aspects, the MDA5 ligand can lack 5'triphosphate and can lack 5' cap of ribose 2'-O-methylation. In some aspects, the MDA5 ligand or TLR3 ligand is a double stranded RNA (dsRNA). In some aspects, the dsRNA comprises 12-6000 base pairs. In some aspects, the dsRNA comprises greater than 11 base pairs. In some aspects, the hairpin RNA comprises 12-6000 base pairs. In some aspects, the hairpin RNA comprises 12-40 base pairs. In some aspects, the MDA5 ligand is any dsRNA 12-40 bp. In some aspects, the dsRNA does not comprise a triphosphate.

In some aspects, the 4-1BB ligand comprises a natural sequence of human 4-1BB ligand (4-1BBL) peptide or a fragment thereof. In some aspects, the 4-1BB ligand comprises human or humanized monoclonal antibody, a monoclonal antibody or Fc fusion protein or wherein the antibody is an antibody fragment comprising scFv, Fab, Fc, heavy chain, light chain, single chain, or complementarity-determining region (CDR), or any combination thereof. In some aspects, the 4-1BB ligand comprises an anti-4-1BB antibody.

In some aspects, the anti-4-1BB monoclonal antibody is fused to an scFv moiety to create a bi-specific molecule. In some aspects, the 4-1BB ligand is fused to a trimerizing domain, such as a collagen C-propeptide of human collagen. In some aspects, the 4-1BB ligand comprises an anti-idiotypic antibody that binds to and activates human 4-1BB and an antibody fragment comprising scFv, Fab, Fc, heavy chain, light chain, single chain, or complementarity-determining region (CDR), or any combination thereof. In some aspects, the 4-1BB ligand comprises urelumab. In some aspects, the urelumab comprises a complex of two moeities of SEQ ID NO: 1225 and two moieties of SEQ ID NO: 1226. In some aspects, the 4-1BB ligand comprises utomilumab. In some aspects, the utomilumab comprises a complex of two moieties of SEQ ID NO: 1228 and two moieties of SEQ ID NO: 1229. In some aspects, the 4-1BB ligand is selected from TABLE 5. In some aspects, the 4-1BB ligand is any one of SEQ ID NO: 1225-SEQ ID NO: 1229.

In some aspects, the STING ligand comprises a cyclic dinucleotide. In some aspects, the cyclic dinucleotide comprises 2',3'-cGAMP. In some aspects, the STING ligand comprises a DMXAA analog. In some aspects, the STING ligand or agonist comprises 4-(2-chloro-6-fluorobenzyl)-N-(furan-2-ylmethyl)-3-oxo-3,4-dihydro-2H-benzo[b][1,4]thiazine-6-carboxamide. In some aspects, the STING ligand comprises one adenosine nucleoside and one inosine nucleoside. In some aspects, the STING ligand comprises dispiro diketopiperzine (DSDP). In some aspects, the STING ligand comprises a synthetic analog of cGAMP. In some aspects, the STING ligand comprises a phosphothioester. In some aspects, the STING ligand is selected from TABLE 8.

In some aspects, the STING ligand acts as an agonist on its target. In some aspects, the peptide is linked to the I/O at an N-terminus, at the epsilon amine of an internal lysine residue, at the carboxylic acid of an aspartic acid or glutamic acid residue, at a cysteine residue, or a C-terminus of the peptide. In some aspects, the peptide further comprises a non-natural amino acid, and wherein the non-natural amino acid is an insertion, appendage, or substitution for another amino acid. In some aspects, the peptide and the I/O are recombinantly expressed as a fusion. In some aspects, the peptide is linked to the I/O at the non-natural amino acid by a linker.

In some aspects, a linker comprises an amide bond, an ester bond, a carbamate bond, a carbonate bond, a hydrazone bond, an oxime bond, a disulfide bond, a thioester bond, a thioether bond, a boronic ester complex, a triazole, a carbon-carbon bond, a carbon-nitrogen bond, or a natural amino acid. In some aspects, the linker has a cleavage rate that can be tuned to selectively cleave in a tumor or in a cell. In some aspects, the peptide-I/O complex comprises a spacer. In some aspects, the peptide and I/O are conjugated. In some aspects, the peptide and I/O are chemically conjugated or conjugated though recombinant fusion. In some aspects, the peptide and the I/O are linked via a cleavable linker.

In some aspects, the cleavable linker is cleaved by low pH, reducing agents, glutathione, a protease, an enzyme, or is hydrolytically labile, generating a cleaved I/O. In some aspects, the enzyme is matrix metalloproteinases, an esterase, thrombin, cathepsin, pepsinogen, gelatinase, elastase, trypsin, plasminogen activators, hyaluronidase, or glucuronidase. In some aspects, the cleavable linker is cleaved only, or preferentially, upon delivery to a tumor microenvironment, on the surface of a cell in the tumor microenvironment, on the surface of a tumor cell, within a cellular cytoplasm, or an intracellular compartment. In some aspects, the intracellular compartment comprises endoplasmic reticulum, endosome, lysosome, or Golgi apparatus.

In some aspects, the cleavable linker comprises any one of SEQ ID NO: 1139-SEQ ID NO: 1161 or SEQ ID NO: 1360-SEQ ID NO: 1363 and SEQ ID NO: 1365. In some aspects, the cleaved I/O is chemically modified as compared to the I/O. In some aspects, the cleaved I/O is not chemically modified as compared to the I/O. In some aspects, the cleaved I/O comprises a different potency or activity as compared to the I/O. In some aspects, the cleaved I/O comprises a different potency or activity as compared to the peptide-I/O complex. In some aspects, the peptide and the I/O are chemically conjugated via a stable linker. In some aspects, the stable linker comprises any one of SEQ ID NO: 1163-SEQ ID NO: 1168. In some aspects, the peptide and I/O are co-formulated.

In some aspects, the peptide and I/O are formulated in a nanoparticle. In some aspects, the I/O is formulated in a nanoparticle and wherein the peptide is bound externally to the nanoparticle. In some aspects, the I/O is encoded for in a vector and formulated in a nanoparticle, and wherein the peptide is bound externally to the nanoparticle. In some aspects, the nanoparticle is a liposome. In some aspects, the vector delivers DNA or mRNA. In some aspects, the ratio of the peptide to the I/O is 1:1, 1:2, 1:3, 1:4, 1:8, 2:1, 3:1, 4:1, or 8:1.

In some aspects, the administering is via inhalation, intranasally, orally, topically, parenterally, intravenously, subcutaneously, intra-tumoral injection, intramuscular administration, intraperitoneal administration, dermal administration, transdermal administration, intracerebroventricular administration, or intrathecal administration, or a combination thereof.

In some aspects, the peptide has at least 70%, at least 75%, at least 80%, at least 85%, at least 90%, at least 91%, at least 92%, at least 93%, at least 94%, at least 95%, at least 96%, at least 97%, at least 98%, at least 99%, or at least 100% sequence identity with any one of SEQ ID NO: 1-SEQ ID NO: 567, SEQ ID NO: 1243-SEQ ID NO: 1252, or SEQ ID NO: 1263-SEQ ID NO: 1289, wherein upon administration to a subject the peptide homes, targets, migrates to, accumulates in, binds to, is retained by, is processed by, or is directed to a tumor of the subject.

In some aspects, the peptide has at least 70%, at least 75%, at least 80%, at least 85%, at least 90%, at least 91%, at least 92%, at least 93%, at least 94%, at least 95%, at least 96%, at least 97%, at least 98%, at least 99%, or at least 100% sequence identity with any one of SEQ ID NO: 568-SEQ ID NO: 1134, SEQ ID NO: 1253-SEQ ID NO: 1262, or SEQ ID NO: 1290-SEQ ID NO: 1316, wherein upon administration to a subject the peptide homes, targets, migrates to, accumulates in, binds to, is retained by, is processed by, or is directed to a tumor of the subject. In some aspects, the peptide targets the I/O to cytoplasm, endoplasmic reticulum, Golgi apparatus, endosome, lysosome, or any combination thereof in a cell. In some aspects, the peptide homes to a cancer. In some aspects, the cancer is a brain cancer, a brain tumor, breast cancer, melanoma, sarcoma, basal cell carcinoma, squamous cell carcinoma, lung, colorectal, prostate and bladder cancer, or any combination thereof.

In some aspects, the composition further comprising administering a PD-1 or PDL1 therapy. In some aspects, the PD-1 or PDL1 therapy comprises PD-1 inhibitors, PDL1 inhibitors, checkpoint inhibitors, or any combination thereof. In some aspects, the peptide comprises 4 or more cysteine residues. In some aspects, the peptide comprises 6 or more cysteine residues. In some aspects, the peptide comprises three or more disulfide bridges formed between cysteine residues.

In some aspects, the peptide comprises three or more disulfide bridges formed between cysteine residues, wherein one of the disulfide bridges passes through a loop formed by two other disulfide bridges. In some aspects, the peptide comprises a plurality of disulfide bridges formed between cysteine residues. In some aspects, the peptide comprises a disulfide through a disulfide knot. In some aspects, at least one amino acid residue of the peptide is in an L configuration or, wherein at least one amino acid residue of the peptide is in a D configuration.

In some aspects, the sequence comprises at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58 residues, at least 59, at least 60, at least 61, at least 62, at least 63, at least 64, at least 65, at least 66, at least 67, at least 68, at least 69, at least 70, at least 71, at least 72, at least 73, at least 74, at least 75, at least 76, at least 77, at least 78, at least 79, at least 80, or at least 81 residues.

In some aspects, any one or more K residues are replaced by an R residue or wherein any one or more R residues are replaced by for a K residue. In some aspects, any one or more M residues are replaced by any one of the I, L, or V residues. In some aspects, any one or more L residues are replaced by any one of the V, I, or M residues. In some aspects, any one or more I residues are replaced by any of the M, L, or V residues. In some aspects, any one or more V residues are replaced by any of the M, I, or L residues. In some aspects, any one or more G residues are replaced by an A residue or wherein any one or more A residues are replaced by a G residue. In some aspects, any one or more S residues are replaced by a T residue or wherein any one or more T residues are replaced by for an S residue. In some aspects, any one or more Q residues are replaced by an N residue or wherein any one or more N residues are replaced by a Q residue. In some aspects, any one or more D residues are replaced by an E residue or wherein any one or more E residues are replaced by a D residue.

In some aspects, at least one residue of the peptide comprises a chemical modification. In some aspects, the chemical modification is blocking the N-terminus of the peptide. In some aspects, the chemical modification is methylation, acetylation, or acylation. In some aspects, the chemical modification is: methylation of one or more lysine residues or analogue thereof; methylation of the N-terminus; or methylation of one or more lysine residue or analogue thereof and methylation of the N-terminus.

In some aspects, the peptide is linked to an acyl adduct. In some aspects, the peptide is SEQ ID NO: 1. In some aspects, the peptide is SEQ ID NO: 2. In some aspects, the peptide is SEQ ID NO: 568. In some aspects, the peptide is SEQ ID NO: 569. In some aspects, the peptide is SEQ ID NO: 570. In some aspects, the peptide-I/O complex further comprises an additional cell penetrating peptide. In some aspects, the cell penetrating peptide enhances cell penetration, cytosolic delivery, endosomal uptake, endosomal escape, or a combination thereof of the peptide-I/O complex.

In some aspects, the cell penetrating peptide comprises any one of SEQ ID NO: 1207-SEQ ID NO: 1224 or SEQ ID NO: 1382-SEQ ID NO: 1400 or SEQ ID NO: 1442-SEQ ID NO: SEQ ID NO: 1490. In some aspects, the cell penetrating peptide is a cysteine dense peptide.

In some aspects, the cysteine dense peptide comprises imperatoxin A, maurocalcine, MCoTI-II, EETI-II, kalata B1, SFTI-1, CyLoP-1, or any combination thereof. In some aspects, a modification is made to the peptide. In some aspects, the modification is addition of an amino acid in a loop region of the peptide, modification of an amino acid in a loop region of the peptide. In some aspects, the modification is incorporation of a non-peptidic molecule, a small molecule, a polymer, a lipid, or any combination thereof. In some aspects, the modification comprises a formulation, non-covalent complexation, grafting, fusion, or any combination thereof.

In some aspects, the peptide comprises a sequence having at least 80%, at least 85%, at least 90%, at least 95%, at least 96%, at least 97%, at least 98%, at least 99%, or at least 100% identical to SEQ ID NO: 1, SEQ ID NO: 2, SEQ ID NO: 568, SEQ ID NO: 569, or SEQ ID NO: 570 and the I/O comprises a sequence of SEQ ID NO: 1135 SEQ ID NO: 1169, SEQ ID NO: 1163, SEQ ID NO: 1176, SEQ ID NO: 1177, SEQ ID NO: 1178, SEQ ID NO: 1179 or a fragment or variant thereof.

In some aspects, the peptide-I/O complex comprises

SEQ ID NO: 569

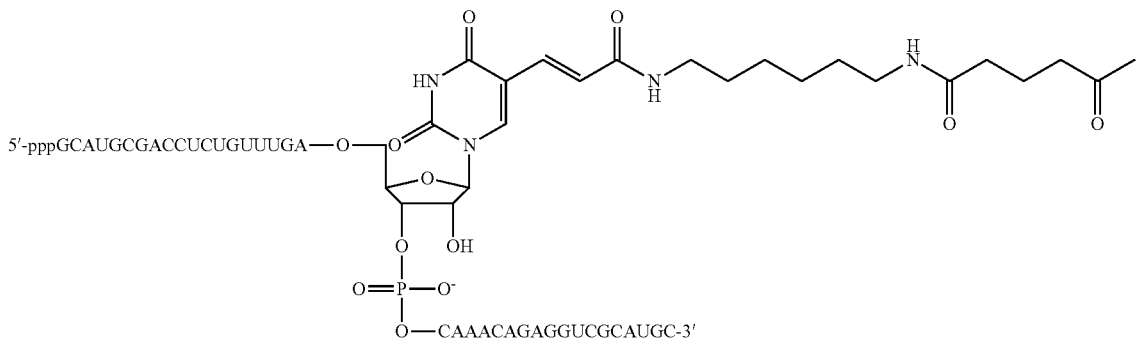

In some aspects, the peptide-I/O complex comprises a RIG-I ligand comprising one or more modified nucleotide bases. In some aspects, the peptide-I/O complex comprises a RIG-I ligand comprising one or more nucleotide bases modified with 2' fluoro groups, phosphorothioate linkages, LNA or BNA nucleic acids, or 2' OMe groups. In some aspects, the peptide-I/O complex comprises a RIG-I ligand comprising one or more bases containing a 2' fluoro modification. In some aspects, the peptide-I/O complex comprises a RIG-I ligand comprising 25%, 50%, 75%, or 100% of bases containing a 2' fluoro modification. In some aspects, the peptide-I/O complex comprises a RIG-I ligand comprising one or more bases containing a phosphorothioate linkage. In some aspects, the peptide-I/O complex comprises a RIG-I ligand comprising at least two of each nucleotides at the 5' and at the 3' end contain a phosphorothioate linkage. In some aspects, the peptide-I/O complex comprises a RIG-I ligand comprising at least two of each nucleotides at the 3' end contain a phosphorothioate linkage.

In some aspects, the peptide-I/O complex comprises:

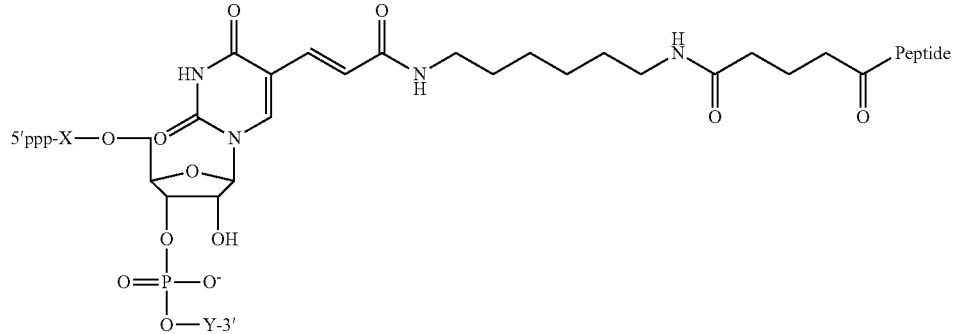

where X and Y are complementary strands of RNA that are each 5-200 bases long and the peptide comprises SEQ ID NO: 569 or SEQ ID NO: 570. In some aspects, the peptide comprises SEQ ID NO: 569 or SEQ ID NO: 570, the I/O comprises a 5'ppp dsRNA, wherein the dsRNA is a double stranded RNA or a hairpin RNA and wherein the dsRNA comp-rises 5-100 base pairs or 10-40 base pairs.

In some aspects, the peptide comprises a sequence having at least 80%, at least 85%, at least 90%, at least 95%, at least 96%, at least 97%, at least 98%, at least 99%, or at least 100% identical to SEQ ID NO: 1, SEQ ID NO: 2, SEQ ID NO: 568, SEQ ID NO: 569, or SEQ ID NO: 570 and the I/O comprises a sequence of SEQ ID NO: 1371, SEQ ID No: 1424 and SEQ ID NO 1425, SEQ ID No: 1375, SEQ ID No: 1376 or a fragment or variant thereof. In some aspects, the composition further comprises CD28-CTLA4, Lag-3, or TIGIT therapy. In some aspects, the peptide-I/O complex comprises the structure set forth in any one of FIG. 34-FIG. 44 and FIG. 55-FIG. 79. In some aspects, the peptide further comprises a diagnostic or imaging agent, such as chemical agent, radiolabel agent, radiosensitizing agent, fluorophore, imaging agent, diagnostic agent, protein, peptide, or small molecule.

In various aspects, the present disclosure provides a method of treating a cancer in a subject in need thereof, the method comprising: administering to the subject a therapeutically effective amount of any one of the compositions described above.

In various aspects, the present disclosure provides a method of delivering an immuno-oncology agent (I/O) to a tumor, the method comprising: a) providing a peptide-immuno-oncology agent complex (peptide-I/O complex) of any one of the above described compositions; and b) administering the peptide-I/O complex to a subject in need thereof, wherein the peptide-I/O complex homes to a tumor after administering.

In various aspects, the present disclosure provides a method of delivering an immuno-oncology agent (I/O) intracellularly, the method comprising a) providing a peptide-immuno-oncology agent complex (peptide-I/O complex) of any one of the above described compositions; and b) administering the peptide-I/O complex to a subject in need thereof, wherein the peptide-I/O complex penetrates a cell after administering.

In various aspects, the present disclosure provides a method of delivering an immuno-oncology agent (I/O) across the blood brain barrier (BBB), the method comprising a) providing a peptide-immuno-oncology agent complex (peptide-I/O complex) of any one of the above described compositions; and b) administering the peptide-I/O complex to a subject in need thereof, wherein the peptide-I/O complex penetrates the BBB after administration.

In various aspects, the present disclosure provides a method of treating or delivering a peptide-I/O complex to a subject in need thereof according to any one of claims 189-192, the method further comprises administering a companion diagnostic or imaging agent, wherein the companion diagnostic or imaging agent comprises a) a peptide-I/O complex of any of the above described compositions, b) a peptide-I/O complex of any of the above described compositions, wherein the peptide further comprises a diagnostic or imaging agent, such as chemical agent, radiolabel agent, radiosensitizing agent, fluorophore, imaging agent, diagnostic agent, protein, peptide, or small molecule; or c) a peptide of SEQ ID NO:1-SEQ ID NO: 1316 further comprising a diagnostic or imaging agent, wherein the diagnostic or imaging agent comprises a chemical agent, a radiolabel agent, radiosensitizing agent, fluorophore, an imaging agent, a diagnostic agent, a protein, a peptide, or a small molecule. In some aspects, the companion diagnostic or imaging agent is detected by a device. In some aspects, the device incorporates radiology or fluorescence, including the X-ray radiography, magnetic resonance imaging (MRI), ultrasound, endoscopy, elastography, tactile imaging, thermography, flow cytometry, medical photography, nuclear medicine functional imaging techniques, positron emission tomography (PET), single-photon emission computed tomography (SPECT), surgical instrument, operating microscope, confocal microscope, fluorescence scope, exoscope, or a surgical robot.

INCORPORATION BY REFERENCE

All publications, patents, and patent applications mentioned, disclosed or referenced in this specification are herein incorporated by reference in their entirety and to the same extent as if each individual publication, patent, or patent application was specifically and individually indicated to be incorporated by reference.

BRIEF DESCRIPTION OF THE FIGURES

The novel features of the invention are set forth with particularity in the appended claims. A better understanding of the features and advantages of the present disclosure will be obtained by reference to the following detailed description that sets forth illustrative embodiments, in which the principles of the disclosure are utilized, and the accompanying drawings of which:

FIG. 1 illustrates incorporation of the shown groups on RNA or DNA.

FIG. 1A illustrates structures of oligonucleotides containing a 5'-thiol (thiohexyl; C6) modification (left), and a 3'-thiol (C3) modification (right).

FIG. 1B illustrates an MMT-hexylaminolinker phosphoramidite.

FIG. 1C illustrates a TFA-pentylaminolinker phosphoramidite.

FIG. 2 discloses SEQ ID NO: 1197.

FIG. 3 illustrates a specific peptide-immuno-oncology agent complex (peptide-I/O complex) comprising an exemplary RLIX peptide-immuno-oncology agent complex (RLIX peptide-I/O complex) comprising an exemplary IL-15 hyperagonist fusion with an exemplary chlorotoxin or chlorotoxin derivative peptide.

FIG. 3B discloses SEQ ID NO: 1173.

FIG. 4 illustrates a specific peptide-I/O complex comprising an exemplary ILRX peptide-immunooncology agent complex (ILRX peptide-I/O complex) comprising an exemplary IL-15 hyperagonist fusion with an exemplary chlorotoxin or chlorotoxin derivative peptide.

FIG. 4A illustrates a cartoon of the exemplary ILRX peptide-I/O complex from the N to C-terminus direction with an exemplary IL-15, linker, IL-15Ra, and chlorotoxin or chlorotoxin derivative peptide.

FIG. 4B illustrates the sequence of the exemplary ILRX peptide-I/O complex of FIG. 4A. FIG. 4B discloses SEQ ID NO: 1174.

FIG. 6 discloses SEQ ID NOS 1199, 1201, 1202, 1516 and 1200, respectively, in order of appearance.

FIG. 12 illustrates STING ligands that can be complexed as an I/O with any peptide of the present disclosure.

FIG. 14 illustrates a short Flu A genome (segment 5; NC-002019), as provided by Schlee et al. Similar structures mimicking a 5'→3' ssRNA that result in hairpin structures, such as SEQ ID NO: 1193, can be used as an analog. FIG. 14 discloses SEQ ID NO: 1517.

FIG. 15 illustrates a genome RNA sequence (NC-002617), as provided by Schlee et al. Similar structures mimicking a 5'→3' ssRNA that result in hairpin structures, such as SEQ ID NO: 1194, can be used as an analog. FIG. 15 discloses SEQ ID NO: 1518.

FIG. 26 illustrates various chemical structures of the present disclosure.

FIG. 28 illustrates proliferation curves for CTLL2 cells.

FIG. 30 illustrates proliferation curves for CD8+ primary human T cells and PHA induced T cell blasts from the same CD8 T cell donor.

FIG. 32 illustrates Cathepsin B cleavage in a CTLL2 proliferation assay.

FIG. 84 shows a low magnification image of the test sites in the A20 lymphoma tumor after 4 hours, as labeled.

FIG. 85 shows a high magnification image of the regions where different select test articles were injected in the A20 lymphoma tumor after 4 hours, as labeled.

DETAILED DESCRIPTION

Figure 1D:
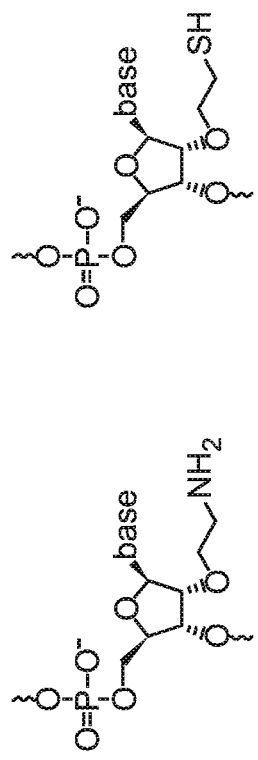
FIG. 1D illustrates RNA residues incorporating amine or thiol residues.

The present disclosure relates generally to compositions and methods for cancer therapy using the application of an immuno-oncology agent, referred to herein as "I/O" or "I/O agent." An "I/O" or "I/O agent," as used herein, is non-limiting and can comprise a single agent, multiple agents, or a complex of agents, with such agents being monomeric, dimer (e.g., homodimeric or heterodimeric), or multimeric (e.g., homomultimeric or heteromultimeric) in structure and with such agents singly, doubly, or multiply complexed, aggregated, modified, fused, linked, or in any combination of the foregoing. In particular, the present disclosure relates to a peptide-immuno-oncology agent complex, referred to herein as a "peptide-I/O complex" for treatment of cancer. In some embodiments, the compositions and methods herein utilize a peptide that homes, targets, is directed to, is retained by, accumulates in, migrates to, is processed by, penetrates and/or binds to tumor cells in combination with an immuno-oncology agent. In some embodiments, the peptide and the peptide-I/O complex can be tumor homing. It is understood that tumor homing can include that the peptide can home, target, be directed to, migrate to, be retained by, accumulate in, or bind to specific regions, tissues, structures, or cells of tumors, and can include accumulation or retention in tumors or cancerous tissue or cells, selective accumulation or penetration of tumor tissue or tumor cells, or can result in increased or higher levels of peptide, and/or any agent complexed with said peptide, in tumor tissues or cells compared to surrounding tissues or cells. In some embodiments, the peptide and the peptide-I/O complex can be cell-penetrating. In some embodiments, the peptide and the peptide-I/O complex can cross the blood brain barrier (BBB). In some embodiments, the peptide and the peptide-I/O complex be cell penetrating by being taken up by cells and can access intracellular compartments, can be endocytosed, can be pinocytosed, can be translocated across the cell membrane, can cross the blood brain barrier (BBB), or can accumulate in or deliver the peptide-I/O complex or I/O to certain intracellular locations. In some embodiments, the peptide and the peptide-I/O complex can be tumor-homing, and can accumulate in or deliver to certain tumor tissues, cells, cellular compartments, and/or the cytosol. In some embodiments, the peptide and the peptide-I/O complex can also cross the BBB and can be used in the treatment of central nervous system (CNS) cancers including brain tumors, metastatic cancer lesions (e.g., within the CNS), and other brain disorders and diseases. For example, the peptide-I/O complex described herein can cross the BBB into the neuronal parenchyma to deliver therapeutically active molecules to targets of neurological diseases including CNS cancers. In some embodiments, the peptide and the peptide-I/O complex can function with any combination of the above properties and can, thus, be cell penetrating, tumor homing, blood-brain barrier crossing, or any combination thereof. Such properties can be modified, optimized, and tuned into the peptide itself or the peptide-I/O complex, as described herein, depending on the desired treatment or disease. In some embodiments, the peptide-I/O complex and the I/O can stimulate a host immune response, including stimulating any of the therapeutic effects described herein. In some embodiments, the present disclosure provides a tumor-homing peptide-I/O complex, a cell penetrating peptide-I/O complex, a BBB-penetrating peptide-I/O complex, a tumor-homing and cell-penetrating and BBB-penetrating peptide-I/O complex, a tumor-homing and cell penetrating peptide-I/O complex, a cell-penetrating and BBB-penetrating peptide-I/O complex, or a tumor-homing and BBB-penetrating peptide-I/O complex.

In certain embodiments, a peptide of this disclosure in combination with the I/O allows for localized delivery of the I/O to the tumor microenvironment, tumor tissues, cells, cellular compartments, and/or the cytosol. Such delivery can also comprise tumor homing and/or cell penetration. By utilizing a tumor homing and/or cell penetrating peptide of the present disclosure to deliver an I/O, the concentration of I/O can be increased in the target tumor microenvironment where it can exert its therapeutic activity. An I/O can be quite potent with serious side effects and such off-target effects can limit the use of said I/O in oncology. Use of peptides of this disclosure can advantageously lead to an increase in the therapeutic window for administration of the I/O and in a decrease in toxicity that can result from systemic-non-specific delivery of the I/O without the peptide. In some embodiments, the peptide and the peptide-I/O complex can be cell penetrating by being taken up by cells, such as by endocytosis or pinocytosis, cleaved, and secreted back out into the tumor microenvironment. In some embodiments, the peptide-I/O complex can be cleaved extracellularly or at the cell surface in the tumor microenvironment. In some embodiments, cell penetrating indicates uptake by endosomes only, uptake by endosomes, processing, and secretion, or uptake and delivery to the cytoplasm. In some embodiments, cell penetration can include delivery to any intracellular compartment. In some embodiments, cell penetration can include delivery to a particular intracellular compartment, such as an endosome, a lysosome, the Golgi apparatus, endoplasmic reticulum, cytosol, or nucleus. The potency or activity of the I/O alone or the peptide-I/O complex can be increased after processing or cleavage in the tumor microenvironment or cell, such that the potency of the peptide-I/O complex is lower during systemic transport and higher after processing in the tumor or tumor microenvironment. Solid tumors can be difficult to penetrate with therapeutic agents, such as with large molecules like antibodies. Some large molecules like antibodies can coat the outer part of a tumor but can penetrate only a lower subtherapeutic level inside parts of the tumors. Peptides of this disclosure can penetrate solid tumors. This penetration of solid tumors by peptides of this disclosure can be due to their smaller size, faster off rates, specific binding interactions, a combination thereof, other properties, or a combination thereof, and can thus increase delivery of an I/O into the tumor, throughout the tumor, or to specific regions of the tumor. In some embodiments, any peptide of this disclosure, for example, any one of SEQ ID NO: 1-SEQ ID NO: 1134, SEQ ID NO: 1243-SEQ ID NO: 1262, or SEQ ID NO: 1263-SEQ ID NO: 1316 can be modified (e.g., mutated) to increase the ability to home to a specific target, such as a tumor, a tissue, a cell, a cellular compartment, or any combination thereof. In some embodiments, any peptide of this disclosure, for example, any one of SEQ ID NO: 1-SEQ ID NO: 1134, SEQ ID NO: 1243-SEQ ID NO: 1262, or SEQ ID NO: 1263-SEQ ID NO: 1316 can be modified (e.g., mutated) to increase efficacy in treatment of any cancer. In certain embodiments, a peptide of this disclosure in combination with the I/O can allow for delivery of the I/O to the cytoplasm, or to endosomes, or to other subcellular compartments of cells of the tumor microenvironment, due to the cell penetrating properties of the peptide. The peptide can carry the I/O across the cell membrane into the cytoplasm. For example, the peptide can carry the I/O across the cell membrane to specific locations within the cytoplasm, such as near the endoplasmic reticulum or the Golgi apparatus. In contrast, without a peptide of this disclosure, the I/O may not be able to enter the cell as efficiently or at all. Thus, the peptides of this disclosure can enable the I/O to access its intracellular target and exert its therapeutic effect. In some embodiments, a peptide of the peptide-I/O complex can allow for entry into the cell, processing of the peptide-I/O complex in the cell, or a combination thereof, wherein the I/O can then be displayed on the cell surface or secreted within the tumor microenvironment. In some embodiments, the I/O of the peptide-I/O complex can be inactive or of reduced activity when in the peptide-I/O complex form, but then after the peptide-I/O is processed in the extracellular space or within the cell, the I/O can be released or activated such that it can be more active than when in the peptide-I/O complex form. This can result in an increase in the concentration of activated I/O in the tumor cell, in the tumor microenvironment, or a combination thereof, after administration of the peptide-I/O complex as compared with administration of the I/O alone. Additionally, this can increase the therapeutic window and efficacy of the I/O as a result of administration of the I/O in a peptide-I/O complex compared with administration of the I/O alone. In some embodiments, the peptides of this disclosure can carry the I/O agent across the blood brain barrier and into the CNS, allowing delivery of the I/O agent to the CNS. Tumor homing properties of the peptides of this disclosure can include accumulating in the tumor microenvironment, retention in the tumor microenvironment, presence in the tumor at higher levels than in other tissues, retention within cells of the tumor. The term "tumor" as used herein can refer to a gross mass consisting of cancer cells, stromal cells, blood vessels, and various infiltrating cells.

In some embodiments, a peptide of the present disclosure and an I/O are delivered together in a complex. This is referred to herein as a "peptide-I/O complex." This peptide-I/O complex can be formed via direct conjugation, co-formulation, formulation in a delivery vehicle (e.g., a liposome or nanoparticle), or recombinant expression of the peptide and I/O together as a fusion. A peptide-I/O complex can also be held together by noncovalent interactions, such as a high affinity receptor-ligand type interaction. A peptide-I/O complex can home to a specific organ and/or tumor-specific compartments. For example, an I/O of the peptide-I/O complex can access targets in the tumor microenvironment, targets in the brain, and/or targets at the cell surface or in the cytoplasm, endoplasmic reticulum, or Golgi apparatus.

Exemplary I/Os of the present disclosure include the immuno-oncology agent (I/O) comprising an IL-15 agent, a RIG-I ligand, a 4-1BB ligand, a STING ligand, an MDA5 ligand, a CGAS ligand, a TLR3 ligand, a TLR7/8 ligand, or a TLR9 ligand. An IL-15 agent, a RIG-I ligand, a 4-1BB ligand, a STING ligand, an MDA5 ligand, a CGAS ligand, a TLR3 ligand, a TLR7/8 ligand, or a TLR9 ligand includes agents or ligands with agonist activity, such as those that act as agonists to activate, stimulate or enhance the function or activity of its respective receptor or target. For example, as used herein, a "ligand" or "agent" is meant to encompass any moiety capable of binding or interacting with a target (e.g., a receptor such as IL-15 receptor (IL-15R), RIG-I, 4-1BB, STING, MDA5, CGAS, TLR3, TLR7/8, or TLR9) to modulate the target's activity or function in, e.g., a tumor microenvironment, tumor tissue, cell, cellular compartment, and/or the cytosol. I/Os of the present disclosure that are "ligands" or "agents" modulate various activities on their targets depending on the interaction and desired effect for the an I/O of the peptide-I/O complex. For example, a ligand or agent when binding or interacting with its target can modulate the activity of the target by acting as an agonist to activate, stimulate or enhance the function of the target, or acting as an antagonist to block, prevent or reduce the function of the target.

The term "ligand" can be used herein to refer to a broad range of I/Os exhibiting binding activity, for example, exhibiting binding to a receptor, such as IL-15 receptor, RIG-I I, 4-1BB, STING, MDA5, CGAS, TLR3, TLR7/8, or TLR9. Ligands can be agonists or antagonists. For example, a "STING ligand" can bind to STING can be a STING agonist. An agonist can refer to a particular I/O that activates a receptor or target to which it binds. An antagonist can refer to a particular I/O that blocks a natural agonist of a receptor or target or blocks the receptor or target's signal transduction pathway, thereby inhibiting activity.

Exemplary I/Os of the present disclosure can further include, but are not limited to, cytokines, including, but not limited to, Type I interferons; interferon gamma; interleukin (IL)-2, IL-7, IL-15, IL-21, IL-12, IL-22, IL-23, IL-24, IL-27, IL-28, IL-29, IL-1, IL-18, IL-33; checkpoint inhibitors including, but not limited to, inhibitors of CTLA-4, PD-1, PD-L1, TIM-3, LAG-3, VISTA, B7-H3, B7-H4, B7S1, galectin 9, CD244, BTLA, CD160, CIS, LIGHT, TIGIT; ligands of pattern recognition receptors (PRRs) including, but not limited to TLR, NLR, ALR, CLR, RLR, RIG-I, MDA5, and STING; molecules that inhibit the macrophage checkpoint CD47, including, but not limited to, SIRPα, which can downregulate CD47 expression at the cell surface of cancer cells or can directly block the CD47-SIRPα interaction; molecules that inhibit the activity of the enzyme indoleamine-2,3-dioxygenase (DO); molecules that block natural killer (NK) cell checkpoints including, but not limited to, CIS, KIR2DL1-3, KIR3DL1, and CD94/NKG2A; and ligands or other agonists or antagonists of TNF family members including, but not limited to, CD40, 4-1BB, OX40, ICOS, CD27, TL-1A, TRAIL, FAS, and GITR. In some embodiments, the peptide-I/O complex is a peptide of the present disclosure complexed with IL-15/IL-15Rα sushi domain, which can be transpresented. In this case, a peptide can deliver the IL-15/IL-15Rα sushi domain to the tumor microenvironment where the I/O can be active extracellularly or on the cell surface. In some embodiments, the peptide-I/O complex is a cell penetrating peptide, that can also be tumor homing, complexed with a RIG-I ligand (e.g., 5'ppp-RNA, at least 20 bases or 2 fluoropyrimidines), a STING ligand (2'-3' cGAMP or variants), or an MDA5 ligand, any of which can then access cytoplasmic targets and act as an agonist.

Additional aspects and advantages of the present disclosure will become apparent to those skilled in this art from the following detailed description, wherein illustrative embodiments of the present disclosure are shown and described. As will be realized, the present disclosure is capable of other and different embodiments, and its several details are capable of modifications in various respects, all without departing from the disclosure. Accordingly, the drawings and description are to be regarded as illustrative in nature, and not as restrictive.

As used herein, the abbreviations for the natural L-enantiomeric amino acids are conventional and are as follows: alanine (A, Ala); arginine (R, Arg); asparagine (N, Asn); aspartic acid (D, Asp); cysteine (C, Cys); glutamic acid (E, Glu); glutamine (Q, Gln); glycine (G, Gly); histidine (H, His); isoleucine (I, Ile); leucine (L, Leu); lysine (K, Lys); methionine (M, Met); phenylalanine (F, Phe); proline (P, Pro); serine (S, Ser); threonine (T, Thr); tryptophan (W, Trp); tyrosine (Y, Tyr); valine (V, Val). Typically, Xaa can indicate any amino acid. In some embodiments, X can be asparagine (N), glutamine (Q), histidine (H), lysine (K), or arginine (R). Abbreviations for other L-enantiomeric amino acids, including non-common proteogenic α-amino acids or natural L-enantiomeric amino acid precursors or intermediates, are sometimes conventional and may or may not have single-letter codes, for example as follows: citrulline (Cit; often designated as X), selenocysteine (U; Sec) and pyrolysine (O; Pyl).

Some embodiments of the disclosure contemplate D-amino acid residues of any standard or non-standard amino acid or analogue thereof. When an amino acid sequence is represented as a series of three-letter or one-letter amino acid abbreviations, the left-hand direction is the amino terminal direction and the right-hand direction is the carboxy terminal direction, in accordance with standard usage and convention.

Peptides

The present disclosure provides peptides that can comprise or can be derived from cysteine-dense peptides. As used herein, the term "cysteine-dense peptide" can be interchangeable with the terms "knotted peptide," "knottin," and "optide," and cysteine-dense peptides can also be abbreviated as "CDPs." Hitchins, amongst other disulfide-containing peptides, can also be considered "knotted peptides" for the purposes of this disclosure. Knottins, for example, are a class of cysteine-dense peptides comprising from about 11 to about 80 amino acids in length that are often folded into a compact structure. Knottins and other cysteine-dense peptides are typically assembled into a complex tertiary structure that is characterized by a number of intramolecular disulfide crosslinks and can contain beta strands, an alpha helix, and other secondary structures. The presence of the disulfide bonds can give cysteine-dense peptides remarkable environmental stability, allowing them to withstand extremes of temperature and pH, to resist proteolytic enzymes in the blood stream or digestive tract, and can provide specific biodistribution, pharmacokinetic, binding interactions, cellular processing, or other properties of physiologic and therapeutic value. The peptides disclosed herein can be derived from certain cysteine-dense peptides.

In some embodiments, cysteine-dense peptides can penetrate tissues due to their compact size. Cysteine-dense peptides can further penetrate solid tumors and can penetrate said solid tumors at higher levels, to a deeper extent, or more thoroughly than other molecules such as antibodies. Cysteine-dense peptides can also cross barriers such as the blood-brain barrier (BBB), the cellular membrane, or other physiological barriers, which may occur due to specific or non-specific binding interactions. Cysteine-dense peptides can be cleared from the circulation, such as more rapidly than an antibody, while accumulating or being retained in other tissues such as tumor tissue or cells. Cysteine-dense peptides can be low in immunogenicity, such as lower than other peptides, proteins, or antibodies, and this can be due to their compact structure and/or resistance to proteases, reducing immune cell processing and presentation. Cysteine-dense peptides can permit mutation of amino acids and of loop regions, while maintaining the compact structure, protease resistance, tumor penetration, or other properties.

The rigidity of cysteine-dense peptides can also allow them to bind to targets without paying the "entropic penalty" that a floppy peptide accrues upon binding a target. For example, binding is adversely affected by the loss of entropy that occurs when a peptide binds a target to form a complex. Therefore, "entropic penalty" is the adverse effect on binding, and the greater the entropic loss that occurs upon this binding, the greater the "entropic penalty." Furthermore, unbound molecules that are flexible lose more entropy when forming a complex than molecules that are rigidly structured, because of the loss of flexibility when bound up in a complex. However, rigidity in the unbound molecule also generally increases specificity by limiting the number of complexes that molecule can form.

The cysteine-dense peptides herein can bind targets with antibody-like affinity. The cysteine-dense peptides can bind Annexin A2, matrix metalloproteinase-2, neuropilin-1, phospholipids, components of lipid rafts, or other targets. Additionally, in some embodiments, cysteine-dense peptides can penetrate into cells. In other embodiments, cysteine-dense peptides exhibit more rapid clearance and cellular uptake compared to other types of molecules.

A cysteine-dense peptide can comprise disulfide bridges. A cysteine-dense peptide can be a peptide wherein 5% or more of the residues are cysteines forming intramolecular disulfide bonds. A cysteine-dense peptide can be a peptide wherein 10% or more of the residues are cysteines forming intramolecular disulfide bonds. A disulfide-linked peptide can be a drug scaffold. In some embodiments, the disulfide bridges form a knot. A disulfide bridge can be formed between cysteine residues, for example, between cysteines 1 and 4, 2 and 5, or, 3 and 6. In some cases, one disulfide bridge passes through a loop formed by the other two disulfide bridges, for example, to form the inhibitor knot. In other cases, the disulfide bridges can be formed between any two cysteine residues.

The present disclosure further includes a peptide of any one of SEQ ID NO: 1-SEQ ID NO: 1134, SEQ ID NO: 1243-SEQ ID NO: 1262, or SEQ ID NO: 1263-SEQ ID NO: 1316 that can be used as peptide scaffolds that, e.g., can be used as a starting point for generating additional peptides that can target and home to tumor microenvironments, tumor tissues, cells, cellular compartments, and/or the cytosol. In some embodiments, these scaffolds can be derived from a variety of cysteine-dense peptides. In certain embodiments, cysteine-dense peptides are assembled into a complex tertiary structure that is characterized by a number of intramolecular disulfide crosslinks, and can contain beta strands and other secondary structures such as an alpha helix. For example, a cysteine-dense peptide can include a small disulfide-rich protein characterized by a disulfide through disulfide knot. This knot can be, e.g., obtained when one disulfide bridge crosses the macrocycle formed by two other disulfides and the interconnecting backbone. In some embodiments, a cysteine-dense peptide can include a growth factor cysteine knot or inhibitor cysteine knot. Other possible peptide structures can include a peptide having two parallel helices linked by two disulfide bridges without β-sheets (e.g., hefutoxin).

A cysteine-dense peptide can comprise at least one amino acid residue in an L configuration. A cysteine-dense peptide can comprise at least one amino acid residue in a D configuration. In some embodiments, a cysteine-dense peptide is at least 11-81 amino acid residues long. In some embodiments, a cysteine-dense peptide is at least 22-63 amino acid residues long. In some embodiments, a cysteine-dense peptide is at least 15-40 amino acid residues long. In other embodiments, a cysteine-dense peptide is at least 11-57 amino acid residues long. In further embodiments, a cysteine-dense peptide is at least 20 amino acid residues long. Moreover, the above embodiments, or active fragments thereof, can be inserted into or fused to other peptides to confer desired properties (e.g., tumor homing, binding, cell penetration, and the like).

The peptides of the present disclosure can comprise cysteine amino acid residues. In some embodiments, the peptide can have at least 4 cysteine amino acid residues. In some cases, the peptide can have at least 6 cysteine amino acid residues. In other cases, the peptide can have at least 8 cysteine amino acid residues, at least 10 cysteine amino acid residues, at least 12 cysteine amino acid residues, at least 14 cysteine amino acid residues or at least 16 cysteine amino acid residues. In certain embodiments, the peptide can comprise at least 4, at least 5, at least 6, at least 7, at least 8, at least 9, at least 10, at least 11, at least 12, at least 13, at least 14, at least 15, or at least 16 cysteine residues.

A cysteine-dense peptide can comprise disulfide bridges. A cysteine-dense peptide can be a peptide wherein 5% or more of the residues are cysteines forming intramolecular disulfide bonds. A disulfide-linked peptide can be a drug scaffold. In some embodiments, a peptide of the present disclosure comprises a plurality of disulfide bridges forming an inhibitor knot. In certain embodiments, the disulfide bridges can be formed between cysteine residues of the peptide. For example, the 1st cysteine residue in the sequence can be disulfide bonded with the 4th cysteine residue in the sequence, the 2nd cysteine residue in the sequence can be disulfide bonded with the 5th cysteine residue in the sequence, and/or the 3rd cysteine residue in the sequence can be disulfide bonded with the 6th cysteine residue in the sequence. In alternative embodiments, the disulfide bridges can be formed between any two cysteine residues. In some cases, one disulfide bridge can pass through a loop or ring formed by two other disulfide bridges to form a disulfide through disulfide knot (e.g., an inhibitor knot), also known as a "two-and-through" system.

TABLE 1 lists some exemplary peptides according to the present disclosure.

TABLE 1

Peptide Sequences

| SEQ ID NO | Sequence |
| --- | --- |
| SEQ ID NO: 1 | GSMCIVIPCFTTDHQMARKCDDCCGGKGRGKCYGPQCLCR |
| SEQ ID NO: 2 | GSMCIVIPCFTTDHQMARRCDDCCGGRGRGKCYGPQCLCR |
| SEQ ID NO: 3 | GSMCIVIPCFTTDHQMARRCDDCCGGRGRGRCYGPQCLCR |
| SEQ ID NO: 4 | GSMCIVIPCFTTDHQMARKCDDCCGGRGRGRCYGPQCLCR |
| SEQ ID NO: 5 | GSMCIVIPCFTTDHQMARRCDDCCGGKGRGRCYGPQCLCR |
| SEQ ID NO: 6 | GSMCIVIPCFTTHHRMAENCDICCGGDGRGKCYGPQCLCR |
| SEQ ID NO: 7 | GSMCIVIPCFTTDTQMQERCDRCCGGGGRGKCWGPQCLCI |
| SEQ ID NO: 8 | GSMCMPCFTTDTQMQERCDRCCGGGGRGRCWGPQCLCI |
| SEQ ID NO: 9 | GSMCMPCFTTEQRMAIICDDCCGGFGRGKCYGPQCLCR |
| SEQ ID NO: 10 | GSMCMPCFTTEQRMAIICDDCCGGFGRGRCYGPQCLCR |
| SEQ ID NO: 11 | GSICIPCFTTDHQIARRCDDCCGGRGRGKCYGPQCICR |
| SEQ ID NO: 12 | GSICIPCFTTDHQIARRCDDCCGGRGRGRCYGPQCICR |
| SEQ ID NO: 13 | GSMCMPCFTTDHRMAENCDICCGGDGRGKCYGPQCLCR |
| SEQ ID NO: 14 | GSMCMPCFTTDHRMAENCDICCGGDGRGRCYGPQCLCR |

TABLE 1-continued

Peptide Sequences

| SEQ ID NO | Sequence |
|---|---|
| SEQ ID NO: 15 | GSMCMPCFTTEQRMAIICDDCCGGFGRGKCYGPQCLCI |
| SEQ ID NO: 16 | GSMCMPCFTTEQRMAIICDDCCGGFGRGRCYGPQCLCI |
| SEQ ID NO: 17 | GSICIPCFTTDHQIARRCDDCCGGRGRGKCYGPQCICI |
| SEQ ID NO: 18 | GSICIPCFTTDHQIARRCDDCCGGRGRGRCYGPQCICI |
| SEQ ID NO: 19 | GSMCMPCFTTDHRMAENCDICCGGDGRGKCYGPQCLCI |
| SEQ ID NO: 20 | GSMCMPCFTTDHRMAENCDICCGGDGRGRCYGPQCLCI |
| SEQ ID NO: 21 | GSMCMPCFTTDTQMEKCDRCCGGGGRGRCWGPQCLCI |
| SEQ ID NO: 22 | GSMCMPCFTTEQRMAIKCDDCCGGFGRGRCYGPQCLCR |
| SEQ ID NO: 23 | GSICIPCFTTDHQIARKCDDCCGGRGRGRCYGPQCICR |
| SEQ ID NO: 24 | GSMCMPCFTTDHRMAEKCDICCGGDGRGRCYGPQCLCR |
| SEQ ID NO: 25 | GSMCMPCFTTDTQMERCDRCCGGKGRGRCWGPQCLCI |
| SEQ ID NO: 26 | GSMCMPCFTTEQRMAIICDDCCGGKGRGRCYGPQCLCR |
| SEQ ID NO: 27 | GSICIPCFTTDHQIARRCDDCCGGKGRGRCYGPQCICR |
| SEQ ID NO: 28 | GSMCMPCFTTDHRMAENCDICCGGKGRGRCYGPQCLCR |
| SEQ ID NO: 29 | GSMCMPCFTTHHRMAENCDICCGGDGRGRCYGPQCLCR |
| SEQ ID NO: 30 | GSMCMPCFTTDTQMERCDRCCGGGGRGRCWGPQCLC |
| SEQ ID NO: 31 | GSMCMPCFTTEQRMAIICDDCCGGFGRGRCYGPQCLC |
| SEQ ID NO: 32 | GSICIPCFTTDHQIARRCDDCCGGRGRGRCYGPQCIC |
| SEQ ID NO: 33 | GSMCMPCFTTDHRMAENCDICCGGDGRGRCYGPQCLC |
| SEQ ID NO: 34 | GSMCMPCFTTDHMARRCDDCCGGRGRGRCYGPQCLCI |
| SEQ ID NO: 35 | GSACAPCFTTDHQAARRCDDCCGGRGRGKCYGPQCLCR |
| SEQ ID NO: 36 | GSACAPCFTTDHQAARKCDDCCGGKGRGKCYGPQCLCR |
| SEQ ID NO: 37 | GSMCMPCFTTHHRMAENCDICCGGDGRGKCYGPQCLCI |
| SEQ ID NO: 38 | GSMCMPCFTTHHRMAENCDICCGGDGRGKCYGPQCLC |
| SEQ ID NO: 39 | GSMCMPCFTTDHQMARRCDDCCGGRGRGRCYGPQCLC |
| SEQ ID NO: 40 | GSMCMPCFTTHHQMAENCDICCGGDGRGKCYGPQCLCR |
| SEQ ID NO: 41 | GSMCMPCFTTHHRMARNCDICCGGDGRGKCYGPQCLCR |
| SEQ ID NO: 42 | GSMCMPCFTTHHRMAERCDICCGGDGRGKCYGPQCLCR |
| SEQ ID NO: 43 | GSMCMPCFTTHHRMAENCDDCCGGDGRGKCYGPQCLCR |
| SEQ ID NO: 44 | GSRCMPCFTTDHQMARRCDDCCGGRGRGKCYGPQCLCR |
| SEQ ID NO: 45 | GSICIPCFTTDHQIARRCDDCCGGRGRGKCYGPQCLCR |
| SEQ ID NO: 46 | GSMCLPCFTTDHQLARRCDDCCGGRGRGKCYGPQCLCR |
| SEQ ID NO: 47 | GSMCMPCFTTEHQMARRCEECCGGRGRGKCYGPQCLCR |
| SEQ ID NO: 48 | GSMCIPCFTTDHQMARRCEECCGGRGRGKCYGPQCLCR |
| SEQ ID NO: 49 | GSICIPCFTTDHQMARRCDDCCGGRGDGKCYGPQCLCR |
| SEQ ID NO: 50 | GSRCNIPCFTTDHFMARFCDFCCGGRGRGKCYGPQCLCR |
| SEQ ID NO: 51 | GSRCNIPCFTTDHYMARYCDYCCGGRGRGKCYGPQCLCR |
| SEQ ID NO: 52 | GSRCNIPCFTTDHRMARRCDRCCGGRGRGKCYGPQCLCR |

TABLE 1-continued

Peptide Sequences

| SEQ ID NO | Sequence |
|---|---|
| SEQ ID NO: 53 | GSRCNIPCFTTDHEMARECDECCGGRGRGKCYGPQCLCR |
| SEQ ID NO: 54 | GSRCNIPCFTTDHEIMARHCDHCCGGRGRGKCYGPQCLCR |
| SEQ ID NO: 55 | GSLCLPCFTTHHRLADQCDICCGGDGRGKCYGPQCLCR |
| SEQ ID NO: 56 | GSICIPCFTTEHQIARRCEECCGGRGRGKCYGPQCLCR |
| SEQ ID NO: 57 | GSMCNIPCFTTIYRMABECDECCGGRGRGKCYGPQCLCR |
| SEQ ID NO: 58 | GSMCNIPCFTTGYRMAEYCDICCGGRGRGKCYGPQCLCR |
| SEQ ID NO: 59 | GSMCNIPCFTTHRRMANTCDACCGGRSRGKCYGPQCLCR |
| SEQ ID NO: 60 | GSHCMPCFTTDHQMIRRCDDCCGGGSYGKCDGPQCLCF |
| SEQ ID NO: 61 | GSDCMPCFTTDHRMADHCDICCGGDDRGKCYGPQCLCR |
| SEQ ID NO: 62 | GSMCNIPCFTTDHEMERRCDDCCGIGGGGKCHGPQCLCG |
| SEQ ID NO: 63 | GSMCNIPCFTTSEQMFRRCDDCCGGWGDGKCNGPHCLCR |
| SEQ ID NO: 64 | GSCGPCFTTDHQMEQKCAECCGGIGKCYGPQCLCNR |
| SEQ ID NO: 65 | GSRCGPCFTTDPQTQAKCSECCGRKGGVCKGPQCICGIQY |
| SEQ ID NO: 66 | GSMCNIPCFTTDPNMAKKCRDCCGGNGKCFGPQCLCNR |
| SEQ ID NO: 67 | GSMCNIPCFTTDHNMAKKCNDCCGGYGKCFGPQCLCR |
| SEQ ID NO: 68 | GSRCPPCFTTNPNMEADCRKCCGGRGYCASYQCICPGG |
| SEQ ID NO: 69 | GSMCNIPCFTTDPNMANKCRDCCGGGKKCFGPQCLCNR |
| SEQ ID NO: 70 | GSMKFLYGVILIALFLTVMTATLSEARCGPCFTTDPQTQAKCSECCGRKGGVCKGPQCICGIQY |
| SEQ ID NO: 71 | GSMCNIPCFTTRPDMAQQCRACCKGRGKCFGPQCLCGYD |
| SEQ ID NO: 72 | GSMKFLYGIVFIALFLTVMTATLSDAMCNIPCFTTDHNMAKKCRDCCGGNGKCFGPQCLCNRG |
| SEQ ID NO: 73 | GSMCNIPCFTTDHNMAKKCRDCCGGNGKCFGPQCLCNR |
| SEQ ID NO: 74 | GSMKFLYGIVFITLFLTVMIATHTEAMCMPCFTTRPNMAQQCRDCCRGRGKCFGPQCLCGYD |
| SEQ ID NO: 75 | GSMKFLYGIVFIALFLTVMIATHTEAMCMPCFTTRPNMAQQCRDCCRGRGKCFGPQCLCGYD |
| SEQ ID NO: 76 | GSRCKPCFTTDPQMSKKCADCCGGKGKGKCYGPQCLC |
| SEQ ID NO: 77 | GSMKFLYGIVFITLFLTVMIATHTEAAMCNIPCFTTNLNMEQECRDCCGGTGRCFGPQCLCGYD |
| SEQ ID NO: 78 | GSRCSPCFTTDQQMTKKCYDCCGGKGKGKCYGPQCICAPY |
| SEQ ID NO: 79 | GSCGPCFTTDPYTESKCATCCGGRGKCVGPQCLCNRI |
| SEQ ID NO: 80 | GSTEAMCNIPCFTTDHNMAKKCRDCCGGNGKCFGYQCLCNRG |
| SEQ ID NO: 81 | GSMKFLYGIVFIALFLTVMFATQTDGCGPCFTTDANMARKCRECCGGIGKCFGPQCLCNRI |
| SEQ ID NO: 82 | GSMKFLYGIVFIALFLTVMFATQTDGCGPCFTTDANMARKCRECCGGNGKCFGPQCLCNRE |
| SEQ ID NO: 83 | GSMKFLYGTILIAFFLTVMIATHSEARCPPCFTTNPNMEADCRKCCGGRGYCASYQCICPGG |
| SEQ ID NO: 84 | GSTEAMCNIPCFTTRPDMAQQCRDCCGGNGKCFGYQCLCNRG |
| SEQ ID NO: 85 | GSMKFLYGIVFIALFLTVMIATLTEAMCNIPCFTTRPDMAQQCRDCCGGNGKCFGYQCLCNRG |

TABLE 1-continued

Peptide Sequences

| SEQ ID NO | Sequence |
|---|---|
| SEQ ID NO: 86 | GSMKFLYGIVFIALFLTVMIATHTEAMCMPCFTTRPDMAQQCRDCCGGNGKCFGYQCLCNRG |
| SEQ ID NO: 87 | GSMKFLYGIILIALFLTVMIATHSEARCPNCFTTNPNAEADCKKCCGNRWGKCAGYQCVCPMK |
| SEQ ID NO: 88 | GSMKFLYGIVFIALFLTGMIATHTEAMCMPCFTTRPDMAQQCRDCCGGNGKCFGYQCLCNRGRIVIMYT |
| SEQ ID NO: 89 | GSMCMPCFTTRPGMAQQCRDCCGGNGKCFGYQCLCNR |
| SEQ ID NO: 90 | GSMCIPCFTTNPNMAAKCNACCGSRRGSCRGPQCICR |
| SEQ ID NO: 91 | GSMCIPCFTTNPNMAAKCNACCGSRRGSCRGPQCICN |
| SEQ ID NO: 92 | GSMCIPCFTTNPNMAAKCNACCGGNGSCRGPQCICN |
| SEQ ID NO: 93 | GSMCIPCFTTNPNMAAKCNACCGSRGRGSCRGPQCICN |
| SEQ ID NO: 94 | GSMCIPCFTTNPNMAAKCNACCGSRGRGKCRGPQCICN |
| SEQ ID NO: 95 | GSMCIPCFTTDHQMAAKCNACCGSRRGSCRGPQCICN |
| SEQ ID NO: 96 | GSMCIPCFTTNHQMAAKCNACCGSRRGSCRGPQCICN |
| SEQ ID NO: 97 | GSMCIPCFTTNPNMARKCNACCGSRGRGSCRGPQCICN |
| SEQ ID NO: 98 | GSMCIPCFTTNPNMAAKCNACCGGKGRGSCRGPQCICN |
| SEQ ID NO: 99 | GSMCIPCFTTNPNMAAKCNACCGSRRGSCFGPQCICN |
| SEQ ID NO: 100 | GSMCIPCFTTNPNMAAKCNACCGSRGRGKCFGPQCICN |
| SEQ ID NO: 101 | GSMCIPCFTTNPNMAAKCNACCGSRGRGSCFGPQCICN |
| SEQ ID NO: 102 | GSMCIPCFTTNPNMAAKCNACCGSRGRGSCYGPQCICN |
| SEQ ID NO: 103 | GSMCIPCFTTNPNMAAKCDACCGSRRGSCRGPQCICN |
| SEQ ID NO: 104 | GSMCIPCFTTNHQMAAKCDACCGSRRGSCRGPQCICN |
| SEQ ID NO: 105 | GSMCIPCFTTNHNMAAKCDACCGGRGRGSCRGPQCICN |
| SEQ ID NO: 106 | GSMCIPCFTTNPNMAAKCDACCGSRGRGSCRGPQCICN |
| SEQ ID NO: 107 | GSMCIPCFTTNPNMAAKCDACCGGKGRGSCRGPQCICN |
| SEQ ID NO: 108 | GSMCIPCFTTNHNMAAKCDACCGSRGRGSCRGPQCICN |
| SEQ ID NO: 109 | GSMCIPCFTTNPNMAAKCRDCCGGRGSCRGPQCICN |
| SEQ ID NO: 110 | GSMCMPCFTTNPNMAAKCDDCCGSRGRGSCRGPQCICN |
| SEQ ID NO: 111 | GSMCIPCFTTNPNMAARCNACCGSRRGSCRGPQCIC |
| SEQ ID NO: 112 | GSMCIPCFTTNPNMAAKCNACCGSRRGSCRGPQCICI |
| SEQ ID NO: 113 | GSMCMPCFTTDHQMARACDDCCGGKGRGKCYGPQCLCR |
| SEQ ID NO: 114 | GSMCMPCFTTDHQMARRCDDCCGGKGRGKCYGPQCLCR |
| SEQ ID NO: 115 | GSMCMPCFTTDHQMARKCDDCCGGAGRGKCYGPQCLCR |
| SEQ ID NO: 116 | GSMCMPCFTTDHQMARACDDCCGGAGRGKCYGPQCLCR |
| SEQ ID NO: 117 | GSMCMPCFTTDHQMARRCDDCCGGAGRGKCYGPQCLCR |
| SEQ ID NO: 118 | GSMCMPCFTTDHQMARKCDDCCGGRGRGKCYGPQCLCR |
| SEQ ID NO: 119 | GSMCMPCFTTDHQMARACDDCCGGRGRGKCYGPQCLCR |
| SEQ ID NO: 120 | GSMCMPCFTTDHQMARKCDDCCGGKGRGACYGPQCLCR |
| SEQ ID NO: 121 | GSMCMPCFTTDHQMARACDDCCGGKGRGACYGPQCLCR |
| SEQ ID NO: 122 | GSMCMPCFTTDHQMARRCDDCCGGKGRGACYGPQCLCR |

TABLE 1-continued

Peptide Sequences

| SEQ ID NO | Sequence |
|---|---|
| SEQ ID NO: 123 | GSMCMPCFTTDHQMARKCDDCCGGAGRGACYGPQCLCR |
| SEQ ID NO: 124 | GSMCMPCFTTDHQMARACDDCCGGAGRGACYGPQCLCR |
| SEQ ID NO: 125 | GSMCMPCFTTDHQMARRCDDCCGGAGRGACYGPQCLCR |
| SEQ ID NO: 126 | GSMCMPCFTTDHQMARKCDDCCGGRGRGACYGPQCLCR |
| SEQ ID NO: 127 | GSMCMPCFTTDHQMARACDDCCGGRGRGACYGPQCLCR |
| SEQ ID NO: 128 | GSMCMPCFTTDHQMARRCDDCCGGRGRGACYGPQCLCR |
| SEQ ID NO: 129 | GSMCMPCFTTDHQMARKCDDCCGGKGRGRCYGPQCLCR |
| SEQ ID NO: 130 | GSMCMPCFTTDHQMARACDDCCGGKGRGRCYGPQCLCR |
| SEQ ID NO: 131 | GSMCMPCFTTDHQMARKCDDCCGGAGRGRCYGPQCLCR |
| SEQ ID NO: 132 | GSMCMPCFTTDHQMARACDDCCGGAGRGRCYGPQCLCR |
| SEQ ID NO: 133 | GSMCMPCFTTDHQMARRCDDCCGGAGRGRCYGPQCLCR |
| SEQ ID NO: 134 | GSMCMPCFTTDHQMARACDDCCGGRGRGRCYGPQCLCR |
| SEQ ID NO: 135 | GSKCNIPCFTTDHQMARRCDDCCGGRGRGRCYGPQCLCR |
| SEQ ID NO: 136 | GSACAPCFTTDHQAARRCDDCCGGRGRGRCYGPQCLCR |
| SEQ ID NO: 137 | GSKCAPCFTTDHQAARRCDDCCGGRGRGRCYGPQCLCR |
| SEQ ID NO: 138 | GSMCMPCFTTDHQMAR(Cit)CDDCCGG(Cit)GRGKCYGPQCLCR |
| SEQ ID NO: 139 | GSMCMPCFTTDHQMAR(Cit)CDDCCGG(Cit)GRG(Cit)CYGPQCLCR |
| SEQ ID NO: 140 | GSKCNIPCFTTDHQMAR(Cit)CDDCCGG(Cit)GRG(Cit)CYGPQCLCR |
| SEQ ID NO: 141 | GSACAPCFTTDHQAAR(Cit)CDDCCGG(Cit)GRGKCYGPQCLCR |
| SEQ ID NO: 142 | GSACAPCFTTDHQAAR(Cit)CDDCCGG(Cit)GRG(Cit)CYGPQCLCR |
| SEQ ID NO: 143 | GSKCAPCFTTDHQAAR(Cit)CDDCCGG(Cit)GRG(Cit)CYGPQCLCR |
| SEQ ID NO: 144 | GSMCMPCFTTDHQMARKCDDCCGGKGRGKCYGPQCLCRGAGAAGG |
| SEQ ID NO: 145 | GSMCMPCFTTDHQMARACDDCCGGKGRGKCYGPQCLCRGAGAAGG |
| SEQ ID NO: 146 | GSMCMPCFTTDHQMARRCDDCCGGKGRGKCYGPQCLCRGAGAAGG |
| SEQ ID NO: 147 | GSMCMPCFTTDHQMARKCDDCCGGAGRGKCYGPQCLCRGAGAAGG |
| SEQ ID NO: 148 | GSMCMPCFTTDHQMARACDDCCGGAGRGKCYGPQCLCRGAGAAGG |
| SEQ ID NO: 149 | GSMCMPCFTTDHQMARRCDDCCGGAGRGKCYGPQCLCRGAGAAGG |
| SEQ ID NO: 150 | GSMCMPCFTTDHQMARKCDDCCGGRGRGKCYGPQCLCRGAGAAGG |
| SEQ ID NO: 151 | GSMCMPCFTTDHQMARACDDCCGGRGRGKCYGPQCLCRGAGAAGG |
| SEQ ID NO: 152 | GSMCMPCFTTDHQMARRCDDCCGGRGRGKCYGPQCLCRGAGAAGG |
| SEQ ID NO: 153 | GSMCMPCFTTDHQMARKCDDCCGGKGRGACYGPQCLCRGAGAAGG |

TABLE 1-continued

Peptide Sequences

| SEQ ID NO | Sequence |
|---|---|
| SEQ ID NO: 154 | GSMCMPCFTTDHQMARACDDCCGGKGRGACYGPQCLCRGAGAAGG |
| SEQ ID NO: 155 | GSMCMPCFTTDHQMARRCDDCCGGKGRGACYGPQCLCRGAGAAGG |
| SEQ ID NO: 156 | GSMCMPCFTTDHQMARKCDDCCGGAGRGACYGPQCLCRGAGAAGG |
| SEQ ID NO: 157 | GSMCMPCFTTDHQMARACDDCCGGAGRGACYGPQCLCRGAGAAGG |
| SEQ ID NO: 158 | GSMCMPCFTTDHQMARRCDDCCGGAGRGACYGPQCLCRGAGAAGG |
| SEQ ID NO: 159 | GSMCMPCFTTDHQMARKCDDCCGGRGRGACYGPQCLCRGAGAAGG |
| SEQ ID NO: 160 | GSMCMPCFTTDHQMARACDDCCGGRGRGACYGPQCLCRGAGAAGG |
| SEQ ID NO: 161 | GSMCMPCFTTDHQMARRCDDCCGGRGRGACYGPQCLCRGAGAAGG |
| SEQ ID NO: 162 | GSMCMPCFTTDHQMARKCDDCCGGKGRGRCYGPQCLCRGAGAAGG |
| SEQ ID NO: 163 | GSMCMPCFTTDHQMARACDDCCGGKGRGRCYGPQCLCRGAGAAGG |
| SEQ ID NO: 164 | GSMCMPCFTTDHQMARRCDDCCGGKGRGRCYGPQCLCRGAGAAGG |
| SEQ ID NO: 165 | GSMCMPCFTTDHQMARKCDDCCGGAGRGRCYGPQCLCRGAGAAGG |
| SEQ ID NO: 166 | GSMCMPCFTTDHQMARACDDCCGGAGRGRCYGPQCLCRGAGAAGG |
| SEQ ID NO: 167 | GSMCMPCFTTDHQMARRCDDCCGGAGRGRCYGPQCLCRGAGAAGG |
| SEQ ID NO: 168 | GSMCMPCFTTDHQMARKCDDCCGGRGRGRCYGPQCLCRGAGAAGG |
| SEQ ID NO: 169 | GSMCMPCFTTDHQMARACDDCCGGRGRGRCYGPQCLCRGAGAAGG |
| SEQ ID NO: 170 | GSMCMPCFTTDHQMARRCDDCCGGRGRGRCYGPQCLCRGAGAAGG |
| SEQ ID NO: 171 | GSKCNIPCFTTDHQMARRCDDCCGGRGRGRCYGPQCLCRGAGAAGG |
| SEQ ID NO: 172 | GSACAPCFTTDHQAARRCDDCCGGRGRGRCYGPQCLCRGAGAAGG |
| SEQ ID NO: 173 | GSKCAPCFTTDHQAARRCDDCCGGRGRGRCYGPQCLCRGAGAAGG |
| SEQ ID NO: 174 | GSMCMPCFTTDHQMAR(Cit)CDDCCGG(Cit)GRGKCYGPQCLCRGAGAAGG |
| SEQ ID NO: 175 | GSMCMPCFTTDHQMAR(Cit)CDDCCGG(Cit)GRG(Cit)CYGPQCLCRGAGAAGG |
| SEQ ID NO: 176 | GSKCNIPCFTTDHQMAR(Cit)CDDCCGG(Cit)GRG(Cit)CYGPQCLCRGAGAAGG |
| SEQ ID NO: 177 | GSACAPCFTTDHQAAR(Cit)CDDCCGG(Cit)GRGKCYGPQCLCRGAGAAGG |
| SEQ ID NO: 178 | GSACAPCFTTDHQAAR(Cit)CDDCCGG(Cit)GRG(Cit)CYGPQCLCRGAGAAGG |

TABLE 1-continued

Peptide Sequences

| SEQ ID NO | Sequence |
|---|---|
| SEQ ID NO: 179 | GSKCAPCFTTDHQAAR(Cit)CDDCCGG(Cit)GRG(Cit)CYGPQCLCRGAGAAGG |
| SEQ ID NO: 180 | GSMCMPCFTTDHQMVRKCDDCCGGKGRGKCYGPQCLCR |
| SEQ ID NO: 181 | GSMCMPCFTTDHQMVRVCDDCCGGKGRGKCYGPQCLCR |
| SEQ ID NO: 182 | GSMCMPCFTTDHQMVRRCDDCCGGKGRGKCYGPQCLCR |
| SEQ ID NO: 183 | GSMCMPCFTTDHQMVRKCDDCCGGVGRGKCYGPQCLCR |
| SEQ ID NO: 184 | GSMCMPCFTTDHQMVRVCDDCCGGVGRGKCYGPQCLCR |
| SEQ ID NO: 185 | GSMCMPCFTTDHQMVRRCDDCCGGVGRGKCYGPQCLCR |
| SEQ ID NO: 186 | GSMCMPCFTTDHQMVRKCDDCCGGRGRGKCYGPQCLCR |
| SEQ ID NO: 187 | GSMCMPCFTTDHQMVRVCDDCCGGRGRGKCYGPQCLCR |
| SEQ ID NO: 188 | GSMCMPCFTTDHQMVRRCDDCCGGRGRGKCYGPQCLCR |
| SEQ ID NO: 189 | GSMCMPCFTTDHQMVRKCDDCCGGKGRGVCYGPQCLCR |
| SEQ ID NO: 190 | GSMCMPCFTTDHQMVRVCDDCCGGKGRGVCYGPQCLCR |
| SEQ ID NO: 191 | GSMCMPCFTTDHQMVRRCDDCCGGKGRGVCYGPQCLCR |
| SEQ ID NO: 192 | GSMCMPCFTTDHQMVRKCDDCCGGVGRGVCYGPQCLCR |
| SEQ ID NO: 193 | GSMCMPCFTTDHQMVRVCDDCCGGVGRGVCYGPQCLCR |
| SEQ ID NO: 194 | GSMCMPCFTTDHQMVRRCDDCCGGVGRGVCYGPQCLCR |
| SEQ ID NO: 195 | GSMCMPCFTTDHQMVRKCDDCCGGRGRGVCYGPQCLCR |
| SEQ ID NO: 196 | GSMCMPCFTTDHQMVRVCDDCCGGRGRGVCYGPQCLCR |
| SEQ ID NO: 197 | GSMCMPCFTTDHQMVRRCDDCCGGRGRGVCYGPQCLCR |
| SEQ ID NO: 198 | GSMCMPCFTTDHQMVRKCDDCCGGKGRGRCYGPQCLCR |
| SEQ ID NO: 199 | GSMCMPCFTTDHQMVRVCDDCCGGKGRGRCYGPQCLCR |
| SEQ ID NO: 200 | GSMCMPCFTTDHQMVRRCDDCCGGKGRGRCYGPQCLCR |
| SEQ ID NO: 201 | GSMCMPCFTTDHQMVRKCDDCCGGVGRGRCYGPQCLCR |
| SEQ ID NO: 202 | GSMCMPCFTTDHQMVRVCDDCCGGVGRGRCYGPQCLCR |
| SEQ ID NO: 203 | GSMCMPCFTTDHQMVRRCDDCCGGVGRGRCYGPQCLCR |
| SEQ ID NO: 204 | GSMCMPCFTTDHQMVRKCDDCCGGRGRGRCYGPQCLCR |
| SEQ ID NO: 205 | GSMCMPCFTTDHQMVRVCDDCCGGRGRGRCYGPQCLCR |
| SEQ ID NO: 206 | GSMCMPCFTTDHQMVRRCDDCCGGRGRGRCYGPQCLCR |
| SEQ ID NO: 207 | GSKCNIPCFTTDHQMVRRCDDCCGGRGRGRCYGPQCLCR |
| SEQ ID NO: 208 | GSVCVPCFTTDHQVVRRCDDCCGGRGRGRCYGPQCLCR |
| SEQ ID NO: 209 | GSKCVPCFTTDHQVVRRCDDCCGGRGRGRCYGPQCLCR |
| SEQ ID NO: 210 | GSMCMPCFTTDHQMVR(Cit)CDDCCGG(Cit)GRGKCYGPQCLCR |
| SEQ ID NO: 211 | GSMCMPCFTTDHQMVR(Cit)CDDCCGG(Cit)GRG(Cit)CYGPQCLCR |
| SEQ ID NO: 212 | GSKCNIPCFTTDHQMVR(Cit)CDDCCGG(Cit)GRG(Cit)CYGPQCLCR |
| SEQ ID NO: 213 | GSVCVPCFTTDHQVVR(Cit)CDDCCGG(Cit)GRGKCYGPQCLCR |
| SEQ ID NO: 214 | GSVCVPCFTTDHQVVR(Cit)CDDCCGG(Cit)GRG(Cit)CYGPQCLCR |
| SEQ ID NO: 215 | GSKCVPCFTTDHQVVR(Cit)CDDCCGG(Cit)GRG(Cit)CYGPQCLCR |

TABLE 1-continued

Peptide Sequences

| SEQ ID NO | Sequence |
|---|---|
| SEQ ID NO: 216 | GSMCMPCFTTDHQMVRKCDDCCGGKGRGKCYGPQCLCRGAGAAGG |
| SEQ ID NO: 217 | GSMCMPCFTTDHQMVRVCDDCCGGKGRGKCYGPQCLCRGAGAAGG |
| SEQ ID NO: 218 | GSMCMPCFTTDHQMVRRCDDCCGGKGRGKCYGPQCLCRGAGAAGG |
| SEQ ID NO: 219 | GSMCMPCFTTDHQMVRKCDDCCGGVGRGKCYGPQCLCRGAGAAGG |
| SEQ ID NO: 220 | GSMCMPCFTTDHQMVRVCDDCCGGVGRGKCYGPQCLCRGAGAAGG |
| SEQ ID NO: 221 | GSMCMPCFTTDHQMVRRCDDCCGGVGRGKCYGPQCLCRGAGAAGG |
| SEQ ID NO: 222 | GSMCMPCFTTDHQMVRKCDDCCGGRGRGKCYGPQCLCRGAGAAGG |
| SEQ ID NO: 223 | GSMCMPCFTTDHQMVRVCDDCCGGRGRGKCYGPQCLCRGAGAAGG |
| SEQ ID NO: 224 | GSMCMPCFTTDHQMVRRCDDCCGGRGRGKCYGPQCLCRGAGAAGG |
| SEQ ID NO: 225 | GSMCMPCFTTDHQMVRKCDDCCGGKGRGVCYGPQCLCRGAGAAGG |
| SEQ ID NO: 226 | GSMCMPCFTTDHQMVRVCDDCCGGKGRGVCYGPQCLCRGAGAAGG |
| SEQ ID NO: 227 | GSMCMPCFTTDHQMVRRCDDCCGGKGRGVCYGPQCLCRGAGAAGG |
| SEQ ID NO: 228 | GSMCMPCFTTDHQMVRKCDDCCGGVGRGVCYGPQCLCRGAGAAGG |
| SEQ ID NO: 229 | GSMCMPCFTTDHQMVRVCDDCCGGVGRGVCYGPQCLCRGAGAAGG |
| SEQ ID NO: 230 | GSMCMPCFTTDHQMVRRCDDCCGGVGRGVCYGPQCLCRGAGAAGG |
| SEQ ID NO: 231 | GSMCMPCFTTDHQMVRKCDDCCGGRGRGVCYGPQCLCRGAGAAGG |
| SEQ ID NO: 232 | GSMCMPCFTTDHQMVRVCDDCCGGRGRGVCYGPQCLCRGAGAAGG |
| SEQ ID NO: 233 | GSMCMPCFTTDHQMVRRCDDCCGGRGRGVCYGPQCLCRGAGAAGG |
| SEQ ID NO: 234 | GSMCMPCFTTDHQMVRKCDDCCGGKGRGRCYGPQCLCRGAGAAGG |
| SEQ ID NO: 235 | GSMCMPCFTTDHQMVRVCDDCCGGKGRGRCYGPQCLCRGAGAAGG |
| SEQ ID NO: 236 | GSMCMPCFTTDHQMVRRCDDCCGGKGRGRCYGPQCLCRGAGAAGG |
| SEQ ID NO: 237 | GSMCMPCFTTDHQMVRKCDDCCGGVGRGRCYGPQCLCRGAGAAGG |
| SEQ ID NO: 238 | GSMCMPCFTTDHQMVRVCDDCCGGVGRGRCYGPQCLCRGAGAAGG |
| SEQ ID NO: 239 | GSMCMPCFTTDHQMVRRCDDCCGGVGRGRCYGPQCLCRGAGAAGG |
| SEQ ID NO: 240 | GSMCMPCFTTDHQMVRKCDDCCGGRGRGRCYGPQCLCRGAGAAGG |

TABLE 1-continued

Peptide Sequences

| SEQ ID NO | Sequence |
|---|---|
| SEQ ID NO: 241 | GSMCMPCFTTDHQMVRVCDDCCGGRGRGRCYGPQCLCRGAGAAGG |
| SEQ ID NO: 242 | GSMCMPCFTTDHQMVRRCDDCCGGRGRGRCYGPQCLCRGAGAAGG |
| SEQ ID NO: 243 | GSKCMPCFTTDHQMVRRCDDCCGGRGRGRCYGPQCLCRGAGAAGG |
| SEQ ID NO: 244 | GSVCVPCFTTDHQVVRRCDDCCGGRGRGRCYGPQCLCRGAGAAGG |
| SEQ ID NO: 245 | GSKCVPCFTTDHQVVRRCDDCCGGRGRGRCYGPQCLCRGAGAAGG |
| SEQ ID NO: 246 | GSMCMPCFTTDHQMVR(Cit)CDDCCGG(Cit)GRGKCYGPQCLCRGAGAAGG |
| SEQ ID NO: 247 | GSMCMPCFTTDHQMVR(Cit)CDDCCGG(Cit)GRG(Cit)CYGPQCLCRGAGAAGG |
| SEQ ID NO: 248 | GSKCNIPCFTTDHQMVR(Cit)CDDCCGG(Cit)GRG(Cit)CYGPQCLCRGAGAAGG |
| SEQ ID NO: 249 | GSVCVPCFTTDHQVVR(Cit)CDDCCGG(Cit)GRGKCYGPQCLCRGAGAAGG |
| SEQ ID NO: 250 | GSVCVPCFTTDHQVVR(Cit)CDDCCGG(Cit)GRG(Cit)CYGPQCLCRGAGAAGG |
| SEQ ID NO: 251 | GSKCVPCFTTDHQVVR(Cit)CDDCCGG(Cit)GRG(Cit)CYGPQCLCRGAGAAGG |
| SEQ ID NO: 252 | GSMCMPCFTTDHQMLRKCDDCCGGKGRGKCYGPQCLCR |
| SEQ ID NO: 253 | GSMCMPCFTTDHQMLRLCDDCCGGKGRGKCYGPQCLCR |
| SEQ ID NO: 254 | GSMCMPCFTTDHQMLRRCDDCCGGKGRGKCYGPQCLCR |
| SEQ ID NO: 255 | GSMCMPCFTTDHQMLRKCDDCCGGLGRGKCYGPQCLCR |
| SEQ ID NO: 256 | GSMCMPCFTTDHQMLRLCDDCCGGLGRGKCYGPQCLCR |
| SEQ ID NO: 257 | GSMCMPCFTTDHQMLRRCDDCCGGLGRGKCYGPQCLCR |
| SEQ ID NO: 258 | GSMCMPCFTTDHQMLRKCDDCCGGRGRGKCYGPQCLCR |
| SEQ ID NO: 259 | GSMCMPCFTTDHQMLRLCDDCCGGRGRGKCYGPQCLCR |
| SEQ ID NO: 260 | GSMCMPCFTTDHQMLRRCDDCCGGRGRGKCYGPQCLCR |
| SEQ ID NO: 261 | GSMCMPCFTTDHQMLRKCDDCCGGKGRGLCYGPQCLCR |
| SEQ ID NO: 262 | GSMCMPCFTTDHQMLRLCDDCCGGKGRGLCYGPQCLCR |
| SEQ ID NO: 263 | GSMCMPCFTTDHQMLRRCDDCCGGKGRGLCYGPQCLCR |
| SEQ ID NO: 264 | GSMCMPCFTTDHQMLRKCDDCCGGLGRGLCYGPQCLCR |
| SEQ ID NO: 265 | GSMCMPCFTTDHQMLRLCDDCCGGLGRGLCYGPQCLCR |
| SEQ ID NO: 266 | GSMCMPCFTTDHQMLRRCDDCCGGLGRGLCYGPQCLCR |
| SEQ ID NO: 267 | GSMCMPCFTTDHQMLRKCDDCCGGRGRGLCYGPQCLCR |
| SEQ ID NO: 268 | GSMCMPCFTTDHQMLRLCDDCCGGRGRGLCYGPQCLCR |
| SEQ ID NO: 269 | GSMCMPCFTTDHQMLRRCDDCCGGRGRGLCYGPQCLCR |
| SEQ ID NO: 270 | GSMCMPCFTTDHQMLRKCDDCCGGKGRGRCYGPQCLCR |
| SEQ ID NO: 271 | GSMCMPCFTTDHQMLRLCDDCCGGKGRGRCYGPQCLCR |
| SEQ ID NO: 272 | GSMCMPCFTTDHQMLRRCDDCCGGKGRGRCYGPQCLCR |
| SEQ ID NO: 273 | GSMCMPCFTTDHQMLRKCDDCCGGLGRGRCYGPQCLCR |

TABLE 1-continued

Peptide Sequences

| SEQ ID NO | Sequence |
|---|---|
| SEQ ID NO: 274 | GSMCMPCFTTDHQMLRLCDDCCGGLGRGRCYGPQCLCR |
| SEQ ID NO: 275 | GSMCMPCFTTDHQMLRRCDDCCGGLGRGRCYGPQCLCR |
| SEQ ID NO: 276 | GSMCMPCFTTDHQMLRKCDDCCGGRGRGRCYGPQCLCR |
| SEQ ID NO: 277 | GSMCMPCFTTDHQMLRLCDDCCGGRGRGRCYGPQCLCR |
| SEQ ID NO: 278 | GSMCMPCFTTDHQMLRRCDDCCGGRGRGRCYGPQCLCR |
| SEQ ID NO: 279 | GSKCNIPCFTTDHQMLRRCDDCCGGRGRGRCYGPQCLCR |
| SEQ ID NO: 280 | GSLCLPCFTTDHQLLRRCDDCCGGRGRGRCYGPQCLCR |
| SEQ ID NO: 281 | GSKCLPCFTTDHQLLRRCDDCCGGRGRGRCYGPQCLCR |
| SEQ ID NO: 282 | GSMCMPCFTTDHQMLR(Cit)CDDCCGG(Cit)GRGKCYGPQCLCR |
| SEQ ID NO: 283 | GSMCMPCFTTDHQMLR(Cit)CDDCCGG(Cit)GRG(Cit)CYGPQCLCR |
| SEQ ID NO: 284 | GSKCNIPCFTTDHQMLR(Cit)CDDCCGG(Cit)GRG(Cit)CYGPQCLCR |
| SEQ ID NO: 285 | GSLCLPCFTTDHQLLR(Cit)CDDCCGG(Cit)GRGKCYGPQCLCR |
| SEQ ID NO: 286 | GSLCLPCFTTDHQLLR(Cit)CDDCCGG(Cit)GRG(Cit)CYGPQCLCR |
| SEQ ID NO: 287 | GSKCLPCFTTDHQLLR(Cit)CDDCCGG(Cit)GRG(Cit)CYGPQCLCR |
| SEQ ID NO: 288 | GSMCMPCFTTDHQMLRKCDDCCGGKGRGKCYGPQCLCRGAGAAGG |
| SEQ ID NO: 289 | GSMCMPCFTTDHQMLRLCDDCCGGKGRGKCYGPQCLCRGAGAAGG |
| SEQ ID NO: 290 | GSMCMPCFTTDHQMLRRCDDCCGGKGRGKCYGPQCLCRGAGAAGG |
| SEQ ID NO: 291 | GSMCMPCFTTDHQMLRKCDDCCGGLGRGKCYGPQCLCRGAGAAGG |
| SEQ ID NO: 292 | GSMCMPCFTTDHQMLRLCDDCCGGLGRGKCYGPQCLCRGAGAAGG |
| SEQ ID NO: 293 | GSMCMPCFTTDHQMLRRCDDCCGGLGRGKCYGPQCLCRGAGAAGG |
| SEQ ID NO: 294 | GSMCMPCFTTDHQMLRKCDDCCGGRGRGKCYGPQCLCRGAGAAGG |
| SEQ ID NO: 295 | GSMCMPCFTTDHQMLRLCDDCCGGRGRGKCYGPQCLCRGAGAAGG |
| SEQ ID NO: 296 | GSMCMPCFTTDHQMLRRCDDCCGGRGRGKCYGPQCLCRGAGAAGG |
| SEQ ID NO: 297 | GSMCMPCFTTDHQMLRKCDDCCGGKGRGLCYGPQCLCRGAGAAGG |
| SEQ ID NO: 298 | GSMCMPCFTTDHQMLRLCDDCCGGKGRGLCYGPQCLCRGAGAAGG |
| SEQ ID NO: 299 | GSMCMPCFTTDHQMLRRCDDCCGGKGRGLCYGPQCLCRGAGAAGG |
| SEQ ID NO: 300 | GSMCMPCFTTDHQMLRKCDDCCGGLGRGLCYGPQCLCRGAGAAGG |
| SEQ ID NO: 301 | GSMCMPCFTTDHQMLRLCDDCCGGLGRGLCYGPQCLCRGAGAAGG |
| SEQ ID NO: 302 | GSMCMPCFTTDHQMLRRCDDCCGGLGRGLCYGPQCLCRGAGAAGG |

TABLE 1-continued

Peptide Sequences

| SEQ ID NO | Sequence |
|---|---|
| SEQ ID NO: 303 | GSMCMPCFTTDHQMLRKCDDCCGGRGRGLCYGPQCLCRGAGA AGG |
| SEQ ID NO: 304 | GSMCMPCFTTDHQMLRLCDDCCGGRGRGLCYGPQCLCRGAGA AGG |
| SEQ ID NO: 305 | GSMCMPCFTTDHQMLRRCDDCCGGRGRGLCYGPQCLCRGAGA AGG |
| SEQ ID NO: 306 | GSMCMPCFTTDHQMLRKCDDCCGGKGRGRCYGPQCLCRGAGA AGG |
| SEQ ID NO: 307 | GSMCMPCFTTDHQMLRLCDDCCGGKGRGRCYGPQCLCRGAGA AGG |
| SEQ ID NO: 308 | GSMCMPCFTTDHQMLRRCDDCCGGKGRGRCYGPQCLCRGAGA AGG |
| SEQ ID NO: 309 | GSMCMPCFTTDHQMLRKCDDCCGGLGRGRCYGPQCLCRGAGA AGG |
| SEQ ID NO: 310 | GSMCMPCFTTDHQMLRLCDDCCGGLGRGRCYGPQCLCRGAGA AGG |
| SEQ ID NO: 311 | GSMCMPCFTTDHQMLRRCDDCCGGLGRGRCYGPQCLCRGAGA AGG |
| SEQ ID NO: 312 | GSMCMPCFTTDHQMLRKCDDCCGGRGRGRCYGPQCLCRGAGA AGG |
| SEQ ID NO: 313 | GSMCMPCFTTDHQMLRLCDDCCGGRGRGRCYGPQCLCRGAGA AGG |
| SEQ ID NO: 314 | GSMCMPCFTTDHQMLRRCDDCCGGRGRGRCYGPQCLCRGAGA AGG |
| SEQ ID NO: 315 | GSKCNIPCFTTDHQMLRRCDDCCGGRGRGRCYGPQCLCRGAGA AGG |
| SEQ ID NO: 316 | GSLCLPCFTTDHQLLRRCDDCCGGRGRGRCYGPQCLCRGAGAA GG |
| SEQ ID NO: 317 | GSKCLPCFTTDHQLLRRCDDCCGGRGRGRCYGPQCLCRGAGAA GG |
| SEQ ID NO: 318 | GSMCMPCFTTDHQMLR(Cit)CDDCCGG(Cit)GRGKCYGPQCLCRG AGAAGG |
| SEQ ID NO: 319 | GSMCMPCFTTDHQMLR(Cit)CDDCCGG(Cit)GRG(Cit)CYGPQCLC RGAGAAGG |
| SEQ ID NO: 320 | GSKCNIPCFTTDHQMLR(Cit)CDDCCGG(Cit)GRG(Cit)CYGPQCLC RGAGAAGG |
| SEQ ID NO: 321 | GSLCLPCFTTDHQLLR(Cit)CDDCCGG(Cit)GRGKCYGPQCLCRGA GAAGG |
| SEQ ID NO: 322 | GSLCLPCFTTDHQLLR(Cit)CDDCCGG(Cit)GRG(Cit)CYGPQCLCR GAGAAGG |
| SEQ ID NO: 323 | GSKCLPCFTTDHQLLR(Cit)CDDCCGG(Cit)GRG(Cit)CYGPQCLCR GAGAAGG |
| SEQ ID NO: 324 | GSGCGPCFTTDHQGARKCDDCCGGKGRGKCYGPQCLCR |
| SEQ ID NO: 325 | GSGCGPCFTTDHQGARACDDCCGGKGRGKCYGPQCLCR |
| SEQ ID NO: 326 | GSGCGPCFTTDHQGARRCDDCCGGKGRGKCYGPQCLCR |
| SEQ ID NO: 327 | GSGCGPCFTTDHQGARKCDDCCGGAGRGKCYGPQCLCR |
| SEQ ID NO: 328 | GSGCGPCFTTDHQGARACDDCCGGAGRGKCYGPQCLCR |
| SEQ ID NO: 329 | GSGCGPCFTTDHQGARRCDDCCGGAGRGKCYGPQCLCR |
| SEQ ID NO: 330 | GSGCGPCFTTDHQGARKCDDCCGGRGRGKCYGPQCLCR |

TABLE 1-continued

Peptide Sequences

| SEQ ID NO | Sequence |
|---|---|
| SEQ ID NO: 331 | GSGCGPCFTTDHQGARACDDCCGGRGRGKCYGPQCLCR |
| SEQ ID NO: 332 | GSGCGPCFTTDHQGARRCDDCCGGRGRGKCYGPQCLCR |
| SEQ ID NO: 333 | GSGCGPCFTTDHQGARKCDDCCGGKGRGACYGPQCLCR |
| SEQ ID NO: 334 | GSGCGPCFTTDHQGARACDDCCGGKGRGACYGPQCLCR |
| SEQ ID NO: 335 | GSGCGPCFTTDHQGARRCDDCCGGKGRGACYGPQCLCR |
| SEQ ID NO: 336 | GSGCGPCFTTDHQGARKCDDCCGGAGRGACYGPQCLCR |
| SEQ ID NO: 337 | GSGCGPCFTTDHQGARACDDCCGGAGRGACYGPQCLCR |
| SEQ ID NO: 338 | GSGCGPCFTTDHQGARRCDDCCGGAGRGACYGPQCLCR |
| SEQ ID NO: 339 | GSGCGPCFTTDHQGARKCDDCCGGRGRGACYGPQCLCR |
| SEQ ID NO: 340 | GSGCGPCFTTDHQGARACDDCCGGRGRGACYGPQCLCR |
| SEQ ID NO: 341 | GSGCGPCFTTDHQGARRCDDCCGGRGRGACYGPQCLCR |
| SEQ ID NO: 342 | GSGCGPCFTTDHQGARKCDDCCGGKGRGRCYGPQCLCR |
| SEQ ID NO: 343 | GSGCGPCFTTDHQGARACDDCCGGKGRGRCYGPQCLCR |
| SEQ ID NO: 344 | GSGCGPCFTTDHQGARRCDDCCGGKGRGRCYGPQCLCR |
| SEQ ID NO: 345 | GSGCGPCFTTDHQGARKCDDCCGGAGRGRCYGPQCLCR |
| SEQ ID NO: 346 | GSGCGPCFTTDHQGARACDDCCGGAGRGRCYGPQCLCR |
| SEQ ID NO: 347 | GSGCGPCFTTDHQGARRCDDCCGGAGRGRCYGPQCLCR |
| SEQ ID NO: 348 | GSGCGPCFTTDHQGARKCDDCCGGRGRGRCYGPQCLCR |
| SEQ ID NO: 349 | GSGCGPCFTTDHQGARACDDCCGGRGRGRCYGPQCLCR |
| SEQ ID NO: 350 | GSGCGPCFTTDHQGARRCDDCCGGRGRGRCYGPQCLCR |
| SEQ ID NO: 351 | GSKCGPCFTTDHQGARRCDDCCGGRGRGRCYGPQCLCR |
| SEQ ID NO: 352 | GSGCGPCFTTDHQGAR(Cit)CDDCCGG(Cit)GRGKCYGPQCLCR |
| SEQ ID NO: 353 | GSGCGPCFTTDHQGAR(Cit)CDDCCGG(Cit)GRG(Cit)CYGPQCLCR |
| SEQ ID NO: 354 | GSKCGPCFTTDHQGAR(Cit)CDDCCGG(Cit)GRG(Cit)CYGPQCLCR |
| SEQ ID NO: 355 | GSACAPCFTTDHQAARACDDCCGGKGRGKCYGPQCLCR |
| SEQ ID NO: 356 | GSACAPCFTTDHQAARRCDDCCGGKGRGKCYGPQCLCR |
| SEQ ID NO: 357 | GSACAPCFTTDHQAARKCDDCCGGAGRGKCYGPQCLCR |
| SEQ ID NO: 358 | GSACAPCFTTDHQAARACDDCCGGAGRGKCYGPQCLCR |
| SEQ ID NO: 359 | GSACAPCFTTDHQAARRCDDCCGGAGRGKCYGPQCLCR |
| SEQ ID NO: 360 | GSACAPCFTTDHQAARKCDDCCGGRGRGKCYGPQCLCR |
| SEQ ID NO: 361 | GSACAPCFTTDHQAARACDDCCGGRGRGKCYGPQCLCR |
| SEQ ID NO: 362 | GSACAPCFTTDHQAARKCDDCCGGKGRGACYGPQCLCR |
| SEQ ID NO: 363 | GSACAPCFTTDHQAARACDDCCGGKGRGACYGPQCLCR |
| SEQ ID NO: 364 | GSACAPCFTTDHQAARRCDDCCGGKGRGACYGPQCLCR |
| SEQ ID NO: 365 | GSACAPCFTTDHQAARKCDDCCGGAGRGACYGPQCLCR |
| SEQ ID NO: 366 | GSACAPCFTTDHQAARACDDCCGGAGRGACYGPQCLCR |
| SEQ ID NO: 367 | GSACAPCFTTDHQAARRCDDCCGGAGRGACYGPQCLCR |
| SEQ ID NO: 368 | GSACAPCFTTDHQAARKCDDCCGGRGRGACYGPQCLCR |

TABLE 1-continued

Peptide Sequences

| SEQ ID NO | Sequence |
|---|---|
| SEQ ID NO: 369 | GSACAPCFTTDHQAARACDDCCGGRGRGACYGPQCLCR |
| SEQ ID NO: 370 | GSACAPCFTTDHQAARRCDDCCGGRGRGACYGPQCLCR |
| SEQ ID NO: 371 | GSACAPCFTTDHQAARKCDDCCGGKGRGRCYGPQCLCR |
| SEQ ID NO: 372 | GSACAPCFTTDHQAARACDDCCGGKGRGRCYGPQCLCR |
| SEQ ID NO: 373 | GSACAPCFTTDHQAARRCDDCCGGKGRGRCYGPQCLCR |
| SEQ ID NO: 374 | GSACAPCFTTDHQAARKCDDCCGGAGRGRCYGPQCLCR |
| SEQ ID NO: 375 | GSACAPCFTTDHQAARACDDCCGGAGRGRCYGPQCLCR |
| SEQ ID NO: 376 | GSACAPCFTTDHQAARRCDDCCGGAGRGRCYGPQCLCR |
| SEQ ID NO: 377 | GSACAPCFTTDHQAARKCDDCCGGRGRGRCYGPQCLCR |
| SEQ ID NO: 378 | GSACAPCFTTDHQAARACDDCCGGRGRGRCYGPQCLCR |
| SEQ ID NO: 379 | GSICIPCFTTDHQIARKCDDCCGGKGRGKCYGPQCLCR |
| SEQ ID NO: 380 | GSICIPCFTTDHQIARACDDCCGGKGRGKCYGPQCLCR |
| SEQ ID NO: 381 | GSICIPCFTTDHQIARRCDDCCGGKGRGKCYGPQCLCR |
| SEQ ID NO: 382 | GSICIPCFTTDHQIARKCDDCCGGAGRGKCYGPQCLCR |
| SEQ ID NO: 383 | GSICIPCFTTDHQIARACDDCCGGAGRGKCYGPQCLCR |
| SEQ ID NO: 384 | GSICIPCFTTDHQIARRCDDCCGGAGRGKCYGPQCLCR |
| SEQ ID NO: 385 | GSICIPCFTTDHQIARKCDDCCGGRGRGKCYGPQCLCR |
| SEQ ID NO: 386 | GSICIPCFTTDHQIARACDDCCGGRGRGKCYGPQCLCR |
| SEQ ID NO: 387 | GSICIPCFTTDHQIARKCDDCCGGKGRGACYGPQCLCR |
| SEQ ID NO: 388 | GSICIPCFTTDHQIARACDDCCGGKGRGACYGPQCLCR |
| SEQ ID NO: 389 | GSICIPCFTTDHQIARRCDDCCGGKGRGACYGPQCLCR |
| SEQ ID NO: 390 | GSICIPCFTTDHQIARKCDDCCGGAGRGACYGPQCLCR |
| SEQ ID NO: 391 | GSICIPCFTTDHQIARACDDCCGGAGRGACYGPQCLCR |
| SEQ ID NO: 392 | GSICIPCFTTDHQIARRCDDCCGGAGRGACYGPQCLCR |
| SEQ ID NO: 393 | GSICIPCFTTDHQIARKCDDCCGGRGRGACYGPQCLCR |
| SEQ ID NO: 394 | GSICIPCFTTDHQIARACDDCCGGRGRGACYGPQCLCR |
| SEQ ID NO: 395 | GSICIPCFTTDHQIARRCDDCCGGRGRGACYGPQCLCR |
| SEQ ID NO: 396 | GSICIPCFTTDHQIARKCDDCCGGKGRGRCYGPQCLCR |
| SEQ ID NO: 397 | GSICIPCFTTDHQIARACDDCCGGKGRGRCYGPQCLCR |
| SEQ ID NO: 398 | GSICIPCFTTDHQIARRCDDCCGGKGRGRCYGPQCLCR |
| SEQ ID NO: 399 | GSICIPCFTTDHQIARKCDDCCGGAGRGRCYGPQCLCR |
| SEQ ID NO: 400 | GSICIPCFTTDHQIARACDDCCGGAGRGRCYGPQCLCR |
| SEQ ID NO: 401 | GSICIPCFTTDHQIARRCDDCCGGAGRGRCYGPQCLCR |
| SEQ ID NO: 402 | GSICIPCFTTDHQIARKCDDCCGGRGRGRCYGPQCLCR |
| SEQ ID NO: 403 | GSICIPCFTTDHQIARACDDCCGGRGRGRCYGPQCLCR |
| SEQ ID NO: 404 | GSICIPCFTTDHQIARRCDDCCGGRGRGRCYGPQCLCR |
| SEQ ID NO: 405 | GSKCIPCFTTDHQIARRCDDCCGGRGRGRCYGPQCLCR |
| SEQ ID NO: 406 | GSICIPCFTTDHQIAR(Cit)CDDCCGG(CiO)GRGKCYGPQCLCR |

TABLE 1-continued

Peptide Sequences

| SEQ ID NO | Sequence |
|---|---|
| SEQ ID NO: 407 | GSICIPCFTTDHQIAR(Cit)CDDCCGG(CiO)GRG(Cit)CYGPQCLCR |
| SEQ ID NO: 408 | GSKCIPCFTTDHQIAR(Cit)CDDCCGG(CiO)GRG(Cit)CYGPQCLCR |
| SEQ ID NO: 409 | GSTCTPCFTTDHQTARKCDDCCGGKGRGKCYGPQCLCR |
| SEQ ID NO: 410 | GSTCTPCFTTDHQTARACDDCCGGKGRGKCYGPQCLCR |
| SEQ ID NO: 411 | GSTCTPCFTTDHQTARRCDDCCGGKGRGKCYGPQCLCR |
| SEQ ID NO: 412 | GSTCTPCFTTDHQTARKCDDCCGGAGRGKCYGPQCLCR |
| SEQ ID NO: 413 | GSTCTPCFTTDHQTARACDDCCGGAGRGKCYGPQCLCR |
| SEQ ID NO: 414 | GSTCTPCFTTDHQTARRCDDCCGGAGRGKCYGPQCLCR |
| SEQ ID NO: 415 | GSTCTPCFTTDHQTARKCDDCCGGRGRGKCYGPQCLCR |
| SEQ ID NO: 416 | GSTCTPCFTTDHQTARACDDCCGGRGRGKCYGPQCLCR |
| SEQ ID NO: 417 | GSTCTPCFTTDHQTARRCDDCCGGRGRGKCYGPQCLCR |
| SEQ ID NO: 418 | GSTCTPCFTTDHQTARKCDDCCGGKGRGACYGPQCLCR |
| SEQ ID NO: 419 | GSTCTPCFTTDHQTARACDDCCGGKGRGACYGPQCLCR |
| SEQ ID NO: 420 | GSTCTPCFTTDHQTARRCDDCCGGKGRGACYGPQCLCR |
| SEQ ID NO: 421 | GSTCTPCFTTDHQTARKCDDCCGGAGRGACYGPQCLCR |
| SEQ ID NO: 422 | GSTCTPCFTTDHQTARACDDCCGGAGRGACYGPQCLCR |
| SEQ ID NO: 423 | GSTCTPCFTTDHQTARRCDDCCGGAGRGACYGPQCLCR |
| SEQ ID NO: 424 | GSTCTPCFTTDHQTARKCDDCCGGRGRGACYGPQCLCR |
| SEQ ID NO: 425 | GSTCTPCFTTDHQTARACDDCCGGRGRGACYGPQCLCR |
| SEQ ID NO: 426 | GSTCTPCFTTDHQTARRCDDCCGGRGRGACYGPQCLCR |
| SEQ ID NO: 427 | GSTCTPCFTTDHQTARKCDDCCGGKGRGRCYGPQCLCR |
| SEQ ID NO: 428 | GSTCTPCFTTDHQTARACDDCCGGKGRGRCYGPQCLCR |
| SEQ ID NO: 429 | GSTCTPCFTTDHQTARRCDDCCGGKGRGRCYGPQCLCR |
| SEQ ID NO: 430 | GSTCTPCFTTDHQTARKCDDCCGGAGRGRCYGPQCLCR |
| SEQ ID NO: 431 | GSTCTPCFTTDHQTARACDDCCGGAGRGRCYGPQCLCR |
| SEQ ID NO: 432 | GSTCTPCFTTDHQTARRCDDCCGGAGRGRCYGPQCLCR |
| SEQ ID NO: 433 | GSTCTPCFTTDHQTARKCDDCCGGRGRGRCYGPQCLCR |
| SEQ ID NO: 434 | GSTCTPCFTTDHQTARACDDCCGGRGRGRCYGPQCLCR |
| SEQ ID NO: 435 | GSTCTPCFTTDHQTARRCDDCCGGRGRGRCYGPQCLCR |
| SEQ ID NO: 436 | GSKCTPCFTTDHQTARRCDDCCGGRGRGRCYGPQCLCR |
| SEQ ID NO: 437 | GSTCTPCFTTDHQTAR(Cit)CDDCCGG(Cit)GRGKCYGPQCLCR |
| SEQ ID NO: 438 | GSTCTPCFTTDHQTAR(Cit)CDDCCGG(Cit)GRG(Cit)CYGPQCLCR |
| SEQ ID NO: 439 | GSKCTPCFTTDHQTAR(Cit)CDDCCGG(Cit)GRG(Cit)CYGPQCLCR |
| SEQ ID NO: 440 | GSVCVPCFTTDHQVARKCDDCCGGKGRGKCYGPQCLCR |
| SEQ ID NO: 441 | GSVCVPCFTTDHQVARACDDCCGGKGRGKCYGPQCLCR |
| SEQ ID NO: 442 | GSVCVPCFTTDHQVARRCDDCCGGKGRGKCYGPQCLCR |
| SEQ ID NO: 443 | GSVCVPCFTTDHQVARKCDDCCGGAGRGKCYGPQCLCR |
| SEQ ID NO: 444 | GSVCVPCFTTDHQVARACDDCCGGAGRGKCYGPQCLCR |

TABLE 1-continued

Peptide Sequences

| SEQ ID NO | Sequence |
|---|---|
| SEQ ID NO: 445 | GSVCVPCFTTDHQVARRCDDCCGGAGRGKCYGPQCLCR |
| SEQ ID NO: 446 | GSVCVPCFTTDHQVARKCDDCCGGRGRGKCYGPQCLCR |
| SEQ ID NO: 447 | GSVCVPCFTTDHQVARACDDCCGGRGRGKCYGPQCLCR |
| SEQ ID NO: 448 | GSVCVPCFTTDHQVARRCDDCCGGRGRGKCYGPQCLCR |
| SEQ ID NO: 449 | GSVCVPCFTTDHQVARKCDDCCGGKGRGACYGPQCLCR |
| SEQ ID NO: 450 | GSVCVPCFTTDHQVARACDDCCGGKGRGACYGPQCLCR |
| SEQ ID NO: 451 | GSVCVPCFTTDHQVARRCDDCCGGKGRGACYGPQCLCR |
| SEQ ID NO: 452 | GSVCVPCFTTDHQVARKCDDCCGGAGRGACYGPQCLCR |
| SEQ ID NO: 453 | GSVCVPCFTTDHQVARACDDCCGGAGRGACYGPQCLCR |
| SEQ ID NO: 454 | GSVCVPCFTTDHQVARRCDDCCGGAGRGACYGPQCLCR |
| SEQ ID NO: 455 | GSVCVPCFTTDHQVARKCDDCCGGRGRGACYGPQCLCR |
| SEQ ID NO: 456 | GSVCVPCFTTDHQVARACDDCCGGRGRGACYGPQCLCR |
| SEQ ID NO: 457 | GSVCVPCFTTDHQVARRCDDCCGGRGRGACYGPQCLCR |
| SEQ ID NO: 458 | GSVCVPCFTTDHQVARKCDDCCGGKGRGRCYGPQCLCR |
| SEQ ID NO: 459 | GSVCVPCFTTDHQVARACDDCCGGKGRGRCYGPQCLCR |
| SEQ ID NO: 460 | GSVCVPCFTTDHQVARRCDDCCGGKGRGRCYGPQCLCR |
| SEQ ID NO: 461 | GSVCVPCFTTDHQVARKCDDCCGGAGRGRCYGPQCLCR |
| SEQ ID NO: 462 | GSVCVPCFTTDHQVARACDDCCGGAGRGRCYGPQCLCR |
| SEQ ID NO: 463 | GSVCVPCFTTDHQVARRCDDCCGGAGRGRCYGPQCLCR |
| SEQ ID NO: 464 | GSVCVPCFTTDHQVARKCDDCCGGRGRGRCYGPQCLCR |
| SEQ ID NO: 465 | GSVCVPCFTTDHQVARACDDCCGGRGRGRCYGPQCLCR |
| SEQ ID NO: 466 | GSVCVPCFTTDHQVARRCDDCCGGRGRGRCYGPQCLCR |
| SEQ ID NO: 467 | GSKCVPCFTTDHQVARRCDDCCGGRGRGRCYGPQCLCR |
| SEQ ID NO: 468 | GSVCVPCFTTDHQVAR(Cit)CDDCCGG(Cit)GRGKCYGPQCLCR |
| SEQ ID NO: 469 | GSVCVPCFTTDHQVAR(Cit)CDDCCGG(Cit)GRG(Cit)CYGPQCLCR |
| SEQ ID NO: 470 | GSKCVPCFTTDHQVAR(Cit)CDDCCGG(Cit)GRG(Cit)CYGPQCLCR |
| SEQ ID NO: 471 | GSLCLPCFTTDHQLARKCDDCCGGKGRGKCYGPQCLCR |
| SEQ ID NO: 472 | GSLCLPCFTTDHQLARACDDCCGGKGRGKCYGPQCLCR |
| SEQ ID NO: 473 | GSLCLPCFTTDHQLARRCDDCCGGKGRGKCYGPQCLCR |
| SEQ ID NO: 474 | GSLCLPCFTTDHQLARKCDDCCGGAGRGKCYGPQCLCR |
| SEQ ID NO: 475 | GSLCLPCFTTDHQLARACDDCCGGAGRGKCYGPQCLCR |
| SEQ ID NO: 476 | GSLCLPCFTTDHQLARRCDDCCGGAGRGKCYGPQCLCR |
| SEQ ID NO: 477 | GSLCLPCFTTDHQLARKCDDCCGGRGRGKCYGPQCLCR |
| SEQ ID NO: 478 | GSLCLPCFTTDHQLARACDDCCGGRGRGKCYGPQCLCR |
| SEQ ID NO: 479 | GSLCLPCFTTDHQLARRCDDCCGGRGRGKCYGPQCLCR |
| SEQ ID NO: 480 | GSLCLPCFTTDHQLARKCDDCCGGKGRGACYGPQCLCR |
| SEQ ID NO: 481 | GSLCLPCFTTDHQLARACDDCCGGKGRGACYGPQCLCR |
| SEQ ID NO: 482 | GSLCLPCFTTDHQLARRCDDCCGGKGRGACYGPQCLCR |

TABLE 1-continued

Peptide Sequences

| SEQ ID NO | Sequence |
|---|---|
| SEQ ID NO: 483 | GSLCLPCFTTDHQLARKCDDCCGGAGRGACYGPQCLCR |
| SEQ ID NO: 484 | GSLCLPCFTTDHQLARACDDCCGGAGRGACYGPQCLCR |
| SEQ ID NO: 485 | GSLCLPCFTTDHQLARRCDDCCGGAGRGACYGPQCLCR |
| SEQ ID NO: 486 | GSLCLPCFTTDHQLARKCDDCCGGRGRGACYGPQCLCR |
| SEQ ID NO: 487 | GSLCLPCFTTDHQLARACDDCCGGRGRGACYGPQCLCR |
| SEQ ID NO: 488 | GSLCLPCFTTDHQLARRCDDCCGGRGRGACYGPQCLCR |
| SEQ ID NO: 489 | GSLCLPCFTTDHQLARKCDDCCGGKGRGRCYGPQCLCR |
| SEQ ID NO: 490 | GSLCLPCFTTDHQLARACDDCCGGKGRGRCYGPQCLCR |
| SEQ ID NO: 491 | GSLCLPCFTTDHQLARRCDDCCGGKGRGRCYGPQCLCR |
| SEQ ID NO: 492 | GSLCLPCFTTDHQLARKCDDCCGGAGRGRCYGPQCLCR |
| SEQ ID NO: 493 | GSLCLPCFTTDHQLARACDDCCGGAGRGRCYGPQCLCR |
| SEQ ID NO: 494 | GSLCLPCFTTDHQLARRCDDCCGGAGRGRCYGPQCLCR |
| SEQ ID NO: 495 | GSLCLPCFTTDHQLARKCDDCCGGRGRGRCYGPQCLCR |
| SEQ ID NO: 496 | GSLCLPCFTTDHQLARACDDCCGGRGRGRCYGPQCLCR |
| SEQ ID NO: 497 | GSLCLPCFTTDHQLARRCDDCCGGRGRGRCYGPQCLCR |
| SEQ ID NO: 498 | GSKCLPCFTTDHQLARRCDDCCGGRGRGRCYGPQCLCR |
| SEQ ID NO: 499 | GSLCLPCFTTDHQLAR(Cit)CDDCCGG(Cit)GRGKCYGPQCLCR |
| SEQ ID NO: 500 | GSLCLPCFTTDHQLAR(Cit)CDDCCGG(Cit)GRG(Cit)CYGPQCLCR |
| SEQ ID NO: 501 | GSKCLPCFTTDHQLAR(Cit)CDDCCGG(Cit)GRG(Cit)CYGPQCLCR |
| SEQ ID NO: 502 | GSSCSPCFTTDHQSARKCDDCCGGKGRGKCYGPQCLCR |
| SEQ ID NO: 503 | GSSCSPCFTTDHQSARACDDCCGGKGRGKCYGPQCLCR |
| SEQ ID NO: 504 | GSSCSPCFTTDHQSARRCDDCCGGKGRGKCYGPQCLCR |
| SEQ ID NO: 505 | GSSCSPCFTTDHQSARKCDDCCGGAGRGKCYGPQCLCR |
| SEQ ID NO: 506 | GSSCSPCFTTDHQSARACDDCCGGAGRGKCYGPQCLCR |
| SEQ ID NO: 507 | GSSCSPCFTTDHQSARRCDDCCGGAGRGKCYGPQCLCR |
| SEQ ID NO: 508 | GSSCSPCFTTDHQSARKCDDCCGGRGRGKCYGPQCLCR |
| SEQ ID NO: 509 | GSSCSPCFTTDHQSARACDDCCGGRGRGKCYGPQCLCR |
| SEQ ID NO: 510 | GSSCSPCFTTDHQSARRCDDCCGGRGRGKCYGPQCLCR |
| SEQ ID NO: 511 | GSSCSPCFTTDHQSARKCDDCCGGKGRGACYGPQCLCR |
| SEQ ID NO: 512 | GSSCSPCFTTDHQSARACDDCCGGKGRGACYGPQCLCR |
| SEQ ID NO: 513 | GSSCSPCFTTDHQSARRCDDCCGGKGRGACYGPQCLCR |
| SEQ ID NO: 514 | GSSCSPCFTTDHQSARKCDDCCGGAGRGACYGPQCLCR |
| SEQ ID NO: 515 | GSSCSPCFTTDHQSARACDDCCGGAGRGACYGPQCLCR |
| SEQ ID NO: 516 | GSSCSPCFTTDHQSARRCDDCCGGAGRGACYGPQCLCR |
| SEQ ID NO: 517 | GSSCSPCFTTDHQSARKCDDCCGGRGRGACYGPQCLCR |
| SEQ ID NO: 518 | GSSCSPCFTTDHQSARACDDCCGGRGRGACYGPQCLCR |
| SEQ ID NO: 519 | GSSCSPCFTTDHQSARRCDDCCGGRGRGACYGPQCLCR |
| SEQ ID NO: 520 | GSSCSPCFTTDHQSARKCDDCCGGKGRGRCYGPQCLCR |

TABLE 1-continued

Peptide Sequences

| SEQ ID NO | Sequence |
|---|---|
| SEQ ID NO: 521 | GSSCSPCFTTDHQSARACDDCCGGKGRGRCYGPQCLCR |
| SEQ ID NO: 522 | GSSCSPCFTTDHQSARRCDDCCGGKGRGRCYGPQCLCR |
| SEQ ID NO: 523 | GSSCSPCFTTDHQSARKCDDCCGGAGRGRCYGPQCLCR |
| SEQ ID NO: 524 | GSSCSPCFTTDHQSARACDDCCGGAGRGRCYGPQCLCR |
| SEQ ID NO: 525 | GSSCSPCFTTDHQSARRCDDCCGGAGRGRCYGPQCLCR |
| SEQ ID NO: 526 | GSSCSPCFTTDHQSARKCDDCCGGRGRGRCYGPQCLCR |
| SEQ ID NO: 527 | GSSCSPCFTTDHQSARACDDCCGGRGRGRCYGPQCLCR |
| SEQ ID NO: 528 | GSSCSPCFTTDHQSARRCDDCCGGRGRGRCYGPQCLCR |
| SEQ ID NO: 529 | GSKCSPCFTTDHQSARRCDDCCGGRGRGRCYGPQCLCR |
| SEQ ID NO: 530 | GSSCSPCFTTDHQSAR(Cit)CDDCCGG(Cit)GRGKCYGPQCLCR |
| SEQ ID NO: 531 | GSSCSPCFTTDHQSAR(Cit)CDDCCGG(Cit)GRG(Cit)CYGPQCLCR |
| SEQ ID NO: 532 | GSKCSPCFTTDHQSAR(Cit)CDDCCGG(Cit)GRG(Cit)CYGPQCLCR |
| SEQ ID NO: 533 | GSMCMPCFTTDPNMARKCRDCCGGNGKCFGPQCLCNRG |
| SEQ ID NO: 534 | GSMCMPCFTTDHNMAKKCRDCCGGNGKCFGYQCLCNRG |
| SEQ ID NO: 535 | GSMCMPCFTTDHQTARRCRDCCGGRGRKCFGQCLCGYD |
| SEQ ID NO: 536 | GSACGPCFTTDPQMAEKCSDCCGGIGTCYGPQCLCNRL |
| SEQ ID NO: 537 | GSMCMPCFTTRPNMAQQCRDCCRGRGKCFGPQCLCG |
| SEQ ID NO: 538 | GSMCMPCFTTRPNMAQQCRDCCRGRGKCFGPQCLCGYD |
| SEQ ID NO: 539 | GSMCMPCFTTNLNMEQECRDCCGGTGRCFGPQCLCG |
| SEQ ID NO: 540 | GSGCNIPCFTTDRYMARKCKECCRGYGNCFGPQCLCNRG |
| SEQ ID NO: 541 | GSGCGPCFTTDANMARKCRECCGGNGKCFGPQCLCNRE |
| SEQ ID NO: 542 | GSGCGPCFTTDANMARKCRECCGGIGKCFGPQCLCNRI |
| SEQ ID NO: 543 | GSMCMPCFTTRPDMAQQCRACCKGRGKCFGPQCLCG |
| SEQ ID NO: 544 | GSMCIPCFTTNPNMAAKCNACCGSRRGSCRGPQCIC |
| SEQ ID NO: 545 | GSMCMPCFTTRPDMAQQCRDCCGGNGKCFGYQCLCNR |
| SEQ ID NO: 546 | GSCGPCFTTDPYTESKCATCCGGRGKCVGPQCLCNR |
| SEQ ID NO: 547 | GSRCGPCFTTDPQTQAKCSECCGRKGGVCKGPQCICG |
| SEQ ID NO: 548 | GSCGPCFTKDPETEKKCATCCGGIGRCFGPQCLCNRG |
| SEQ ID NO: 549 | GSMCMPCFTTDHQMARRCDDCCGGRGRGKCWGPQCLCR |
| SEQ ID NO: 550 | GSAMCMPCFTTDHNMAKKCRDCCGGNGKCFGPQCLCNRG |
| SEQ ID NO: 551 | GSCGPCFTTDWESEKKCAECCGGIGRCFGPQCLCNRK |
| SEQ ID NO: 552 | GSCGPCFTTDHQTEQKCAECCGGIGKCYGPQCLCRG |
| SEQ ID NO: 553 | GSCGPCFTTDRQMEQKCAECCGGIGKCYGPQCLCRG |
| SEQ ID NO: 554 | GSCGPCFTTDHQTEQKCAECCGGIGKCYGPQCLC |
| SEQ ID NO: 555 | GSCNIPCFTTDHQMARKCDDCCGGRGKCYGPQCLCRG |
| SEQ ID NO: 556 | GSRCGPCFTTDPQTQAKCSECCGRKGGVCKGPQCICGIQ |
| SEQ ID NO: 557 | GSRCPPCFTTNPNMEADCRKCCGGRGYCASYQCICPG |
| SEQ ID NO: 558 | GSCGPCFTTDHNMARKCDECCGGKGRGKCFGPQCLCR |

TABLE 1-continued

Peptide Sequences

| SEQ ID NO | Sequence |
|---|---|
| SEQ ID NO: 559 | GSVCNIPCFTTDQQMARKCSDCCGGKGRGKCYGPQCLCR |
| SEQ ID NO: 560 | GSMCGPCFTTDANMARKCRECCGGIGKCFGPQCLCNRI |
| SEQ ID NO: 561 | GSMCGPCFTTDANMAAACRECCGGIGKCFGPQCLCNRI |
| SEQ ID NO: 562 | GSMCGPCFTTDANMARKCAECCGGIGKCFGPQCLCNRI |
| SEQ ID NO: 563 | GSMCGPCFTTDANMARKCRECCGGIGACFGPQCLCNRI |
| SEQ ID NO: 564 | GSMCGPCFTTDANMARKCRECCGGIGKCFGPQCLCNAI |
| SEQ ID NO: 565 | GSCNIPCFTTRPNMAQQCRDCCRGRGKCFGPQCLCGYD |
| SEQ ID NO: 566 | GSMCMPCFTTNLNMEQECRDCCGGTGRCFGPQCLCGYD |
| SEQ ID NO: 567 | GSCNIPCFTTRPNMAQQCRDCCRGRGKCFGPQCLCGYD |
| SEQ ID NO: 1243 | GSEISCEPGKTFKDKCNTCRCGADGKSAACTLKACPNQ |
| SEQ ID NO: 1244 | GSSCEPGRTFRDRCNTCRCGADGRSAACTLRACPNQ |
| SEQ ID NO: 1245 | GSSCEPGRTFRDRCNTCKCGADGRSAACTLRACPNQ |
| SEQ ID NO: 1246 | GSSCEPGTTFRDRCNTCRCGSDGRSAACTLRACPQ |
| SEQ ID NO: 1247 | GSSCTPGTTFRDRCNTCRCSSNGRSAACTLRACPPGSY |
| SEQ ID NO: 1248 | GSSCTPGTTFRNRCNTCRCGSNGRSASCTLMACPPGSY |
| SEQ ID NO: 1249 | GSSCTPGATFRNRCNTCRCGSNGRSASCTLMACPPGSY |
| SEQ ID NO: 1250 | GSSCQPGTTYQRGCNTCRCLEDGQTEACTLRLC |
| SEQ ID NO: 1251 | GSSCTPGATYREGCNICRCRSDGRSGACTRRICPVDSN |
| SEQ ID NO: 1252 | GSSCQPGTTFRRDCNTCVCNRDGTNAACTLRACL |
| SEQ ID NO: 568 | MCMPCFTTDHQMARKCDDCCGGKGRGKCYGPQCLCR |
| SEQ ID NO: 569 | MCMPCFTTDHQMARRCDDCCGGRGRGKCYGPQCLCR |
| SEQ ID NO: 570 | MCMPCFTTDHQMARRCDDCCGGRGRGRCYGPQCLCR |
| SEQ ID NO: 571 | MCMPCFTTDHQMARKCDDCCGGRGRGRCYGPQCLCR |
| SEQ ID NO: 572 | MCMPCFTTDHQMARRCDDCCGGKGRGKCYGPQCLCR |
| SEQ ID NO: 573 | MCMPCFTTHHRMAENCDICCGGDGRGKCYGPQCLCR |
| SEQ ID NO: 574 | MCMPCFTTDTQMQERCDRCCGGGGRGKCWGPQCLCI |
| SEQ ID NO: 575 | MCMPCFTTDTQMQERCDRCCGGGGRGRCWGPQCLCI |
| SEQ ID NO: 576 | MCMPCFTTEQRMAIICDDCCGGFGRGKCYGPQCLCR |
| SEQ ID NO: 577 | MCMPCFTTEQRMAIICDDCCGGFGRGRCYGPQCLCR |
| SEQ ID NO: 578 | ICIPCFTTDHQIARRCDDCCGGRGRGKCYGPQCICR |
| SEQ ID NO: 579 | ICIPCFTTDHQIARRCDDCCGGRGRGRCYGPQCICR |
| SEQ ID NO: 580 | MCMPCFTTDHRMAENCDICCGGDGRGKCYGPQCLCR |
| SEQ ID NO: 581 | MCMPCFTTDHRMAENCDICCGGDGRGRCYGPQCLCR |
| SEQ ID NO: 582 | MCMPCFTTEQRMAIICDDCCGGFGRGKCYGPQCLCI |
| SEQ ID NO: 583 | MCMPCFTTEQRMAIICDDCCGGFGRGRCYGPQCLCI |
| SEQ ID NO: 584 | ICIPCFTTDHQIARRCDDCCGGRGRGKCYGPQCICI |
| SEQ ID NO: 585 | ICIPCFTTDHQIARRCDDCCGGRGRGRCYGPQCICI |
| SEQ ID NO: 586 | MCMPCFTTDHRMAENCDICCGGDGRGKCYGPQCLCI |

TABLE 1-continued

Peptide Sequences

| SEQ ID NO | Sequence |
|---|---|
| SEQ ID NO: 587 | MCMPCFTTDHRMAENCDICCGGDGRGRCYGPQCLCI |
| SEQ ID NO: 588 | MCMPCFTTDTQMQEKCDRCCGGGGRGRCWGPQCLCI |
| SEQ ID NO: 589 | MCMPCFTTEQRMAIKCDDCCGGFGRGRCYGPQCLCR |
| SEQ ID NO: 590 | ICIPCFTTDHQIARKCDDCCGGRGRGRCYGPQCICR |
| SEQ ID NO: 591 | MCMPCFTTDHRMAEKCDICCGGDGRGRCYGPQCLCR |
| SEQ ID NO: 592 | MCMPCFTTDTQMQERCDRCCGGKGRGRCWGPQCLCI |
| SEQ ID NO: 593 | MCMPCFTTEQRMAIICDDCCGGKGRGRCYGPQCLCR |
| SEQ ID NO: 594 | ICIPCFTTDHQIARRCDDCCGGKGRGRCYGPQCICR |
| SEQ ID NO: 595 | MCMPCFTTDHRMAENCDICCGGKGRGRCYGPQCLCR |
| SEQ ID NO: 596 | MCMPCFTTHHRMAENCDICCGGDGRGRCYGPQCLCR |
| SEQ ID NO: 597 | MCMPCFTTDTQMQERCDRCCGGGGRGRCWGPQCLC |
| SEQ ID NO: 598 | MCMPCFTTEQRMAIICDDCCGGFGRGRCYGPQCLC |
| SEQ ID NO: 599 | ICIPCFTTDHQIARRCDDCCGGRGRGRCYGPQCIC |
| SEQ ID NO: 600 | MCMPCFTTDHRMAENCDICCGGDGRGRCYGPQCLC |
| SEQ ID NO: 601 | MCMPCFTTDHQMARRCDDCCGGRGRGRCYGPQCLCI |
| SEQ ID NO: 602 | ACAPCFTTDHQAARRCDDCCGGKGRGKCYGPQCLCR |
| SEQ ID NO: 603 | ACAPCFTTDHQAARKCDDCCGGKGRGKCYGPQCLCR |
| SEQ ID NO: 604 | MCMPCFTTHHRMAENCDICCGGDGRGKCYGPQCLCI |
| SEQ ID NO: 605 | MCMPCFTTHHRMAENCDICCGGDGRGKCYGPQCLC |
| SEQ ID NO: 606 | MCMPCFTTDHQMARRCDDCCGGRGRGRCYGPQCLC |
| SEQ ID NO: 607 | MCMPCFTTHHQMAENCDICCGGDGRGKCYGPQCLCR |
| SEQ ID NO: 608 | MCMPCFTTHHRMARNCDICCGGDGRGKCYGPQCLCR |
| SEQ ID NO: 609 | MCMPCFTTHHRMAERCDICCGGDGRGKCYGPQCLCR |
| SEQ ID NO: 610 | MCMPCFTTHHRMAENCDDCCGGDGRGKCYGPQCLCR |
| SEQ ID NO: 611 | RCMPCFTTDHQMARRCDDCCGGRGRGKCYGPQCLCR |
| SEQ ID NO: 612 | ICIPCFTTDHQIARRCDDCCGGRGRGKCYGPQCLCR |
| SEQ ID NO: 613 | MCLPCFTTDHQLARRCDDCCGGRGRGKCYGPQCLCR |
| SEQ ID NO: 614 | MCMPCFTTEHQMARRCEECCGGRGRGKCYGPQCLCR |
| SEQ ID NO: 615 | MCIPCFTTDHQMARRCEECCGGRGRGKCYGPQCLCR |
| SEQ ID NO: 616 | ICIPCFTTDHQMARRCDDCCGGRGDGKCYGPQCLCR |
| SEQ ID NO: 617 | RCMPCFTTDHFMARFCDFCCGGRGRGKCYGPQCLCR |
| SEQ ID NO: 618 | RCMPCFTTDHYMARYCDYCCGGRGRGKCYGPQCLCR |
| SEQ ID NO: 619 | RCMPCFTTDHRMARRCDRCCGGRGRGKCYGPQCLCR |
| SEQ ID NO: 620 | RCMPCFTTDHEMARECDECCGGRGRGKCYGPQCLCR |
| SEQ ID NO: 621 | RCMPCFTTDEIRMARHCDHCCGGRGRGKCYGPQCLCR |
| SEQ ID NO: 622 | LCLPCFTTHHRLADQCDICCGGDGRGKCYGPQCLCR |
| SEQ ID NO: 623 | ICIPCFTTEHQIARRCEECCGGRGRGKCYGPQCLCR |
| SEQ ID NO: 624 | MCMPCFTTIYRMAHECDECCGGRGRGKCYGPQCLCR |

TABLE 1-continued

Peptide Sequences

| SEQ ID NO | Sequence |
|---|---|
| SEQ ID NO: 625 | MCMPCFTTGYRMAEYCDICCGGRGRGKCYGPQCLCR |
| SEQ ID NO: 626 | MCMPCFTTHRRMANTCDACCGGRSRGKCYGPQCLCR |
| SEQ ID NO: 627 | HCMPCFTTDHQMIRRCDDCCGGGSYGKCDGPQCLCF |
| SEQ ID NO: 628 | DCMPCFTTDHRMADHCDICCGGDDRGKCYGPQCLCR |
| SEQ ID NO: 629 | MCMPCFTTDHEMERRCDDCCGIGGGGKCHGPQCLCG |
| SEQ ID NO: 630 | MCMPCFTTSEQMFRRCDDCCGGWGDGKCNGPHCLCR |
| SEQ ID NO: 631 | CGPCFTTDHQMEQKCAECCGGIGKCYGPQCLCNR |
| SEQ ID NO: 632 | RCGPCFTTDPQTQAKCSECCGRKGGVCKGPQCICGIQY |
| SEQ ID NO: 633 | MCMPCFTTDPNMAKKCRDCCGGNGKCFGPQCLCNR |
| SEQ ID NO: 634 | MCMPCFTTDHNMAKKCNDCCGGYGKCFGPQCLCR |
| SEQ ID NO: 635 | RCPPCFTTNPNMEADCRKCCGGRGYCASYQCICPGG |
| SEQ ID NO: 636 | MCMPCFTTDPNMANKCRDCCGGGKKCFGPQCLCNR |
| SEQ ID NO: 637 | MKFLYGVILIALFLTVMTATLSEARCGPCFTTDPQTQAKCSECCGRKGGVCKGPQCICGIQY |
| SEQ ID NO: 638 | MCMPCFTTRPDMAQQCRACCKGRGKCFGPQCLCGYD |
| SEQ ID NO: 639 | MKFLYGIVFIALFLTVMTATLSDAMCMPCFTTDHNMAKKCRDCCGGNGKCFGPQCLCNRG |
| SEQ ID NO: 640 | MCMPCFTTDHNMAKKCRDCCGGNGKCFGPQCLCNR |
| SEQ ID NO: 641 | MKFLYGIVFITLFLTVMIATHTEAMCMPCFTTRPNMAQQCRDCCRGRGKCFGPQCLCGYD |
| SEQ ID NO: 642 | MKFLYGIVFIALFLTVMIATHTEAMCMPCFTTRPNMAQQCRDCCRGRGKCFGPQCLCGYD |
| SEQ ID NO: 643 | RCKPCFTTDPQMSKKCADCCGGKGKGKCYGPQCLC |
| SEQ ID NO: 644 | MKFLYGIVFITLFLTVMIATHTEAMCMPCFTTNLNMEQECRDCCGGTGRCFGPQCLCGYD |
| SEQ ID NO: 645 | RCSPCFTTDQQMTKKCYDCCGGKGKGKCYGPQCICAPY |
| SEQ ID NO: 646 | CGPCFTTDPYTESKCATCCGGRGKCVGPQCLCNRI |
| SEQ ID NO: 647 | TEAMCMPCFTTDHNMAKKCRDCCGGNGKCFGYQCLCNRG |
| SEQ ID NO: 648 | MKFLYGIVFIALFLTVMFATQTDGCGPCFTTDANMARKCRECCGGIGKCFGPQCLCNRI |
| SEQ ID NO: 649 | MKFLYGIVFIALFLTVMFATQTDGCGPCFTTDANMARKCRECCGGNGKCFGPQCLCNRE |
| SEQ ID NO: 650 | MKFLYGTILIAFFLTVMIATHSEARCPPCFTTNPNMEADCRKCCGGRGYCASYQCICPGG |
| SEQ ID NO: 651 | TEAMCMPCFTTRPDMAQQCRDCCGGNGKCFGYQCLCNRG |
| SEQ ID NO: 652 | MKFLYGIVFIALFLTVMIATLTEAMCMPCFTTRPDMAQQCRDCCGGNGKCFGYQCLCNRG |
| SEQ ID NO: 653 | MKFLYGIVFIALFLTVMIATHTEAMCMPCFTTRPDMAQQCRDCCGGNGKCFGYQCLCNRG |
| SEQ ID NO: 654 | MKFLYGIILIALFLTVMIATHSEARCPNCFTTNPNAEADCKKCCGNRWGKCAGYQCVCPMK |
| SEQ ID NO: 655 | MKFLYGIVFIALFLTGMIATHTEAMCMPCFTTRPDMAQQCRDCCGGNGKCFGYQCLCNRGRIVIMYT |
| SEQ ID NO: 656 | MCMPCFTTRPGMAQQCRDCCGGNGKCFGYQCLCNR |

TABLE 1-continued

Peptide Sequences

| SEQ ID NO | Sequence |
|---|---|
| SEQ ID NO: 657 | MCIPCFTTNPNMAAKCNACCGSRRGSCRGPQCICR |
| SEQ ID NO: 658 | MCIPCFTTNPNMAAKCNACCGSRRGSCRGPQCICN |
| SEQ ID NO: 659 | MCIPCFTTNPNMAAKCNACCGGNGSCRGPQCICN |
| SEQ ID NO: 660 | MCIPCFTTNPNMAAKCNACCGSRGRGSCRGPQCICN |
| SEQ ID NO: 661 | MCIPCFTTNPNMAAKCNACCGSRGRGKCRGPQCICN |
| SEQ ID NO: 662 | MCIPCFTTDHQMAAKCNACCGSRRGSCRGPQCICN |
| SEQ ID NO: 663 | MCIPCFTTNHQMAAKCNACCGSRRGSCRGPQCICN |
| SEQ ID NO: 664 | MCIPCFTTNPNMARKCNACCGSRGRGSCRGPQCICN |
| SEQ ID NO: 665 | MCIPCFTTNPNMAAKCNACCGGKGRGSCRGPQCICN |
| SEQ ID NO: 666 | MCIPCFTTNPNMAAKCNACCGSRRGSCFGPQCICN |
| SEQ ID NO: 667 | MCIPCFTTNPNMAAKCNACCGSRGRGKCFGPQCICN |
| SEQ ID NO: 668 | MCIPCFTTNPNMAAKCNACCGSRGRGSCFGPQCICN |
| SEQ ID NO: 669 | MCIPCFTTNPNMAAKCNACCGSRGRGSCYGPQCICN |
| SEQ ID NO: 670 | MCIPCFTTNPNMAAKCDACCGSRRGSCRGPQCICN |
| SEQ ID NO: 671 | MCIPCFTTNHQMAAKCDACCGSRRGSCRGPQCICN |
| SEQ ID NO: 672 | MCIPCFTTNHNMAAKCDACCGGRGRGSCRGPQCICN |
| SEQ ID NO: 673 | MCIPCFTTNPNMAAKCDACCGSRGRGSCRGPQCICN |
| SEQ ID NO: 674 | MCIPCFTTNPNMAAKCDACCGGKGRGSCRGPQCICN |
| SEQ ID NO: 675 | MCIPCFTTNHNMAAKCDACCGSRGRGSCRGPQCICN |
| SEQ ID NO: 676 | MCIPCFTTNPNMAAKCRDCCGGRGSCRGPQCICN |
| SEQ ID NO: 677 | MCMPCFTTNPNMAAKCDDCCGSRGRGSCRGPQCICN |
| SEQ ID NO: 678 | MCIPCFTTNPNMAARCNACCGSRRGSCRGPQCIC |
| SEQ ID NO: 679 | MCIPCFTTNPNMAAKCNACCGSRRGSCRGPQCICI |
| SEQ ID NO: 680 | MCMPCFTTDHQMARACDDCCGGKGRGKCYGPQCLCR |
| SEQ ID NO: 681 | MCMPCFTTDHQMARRCDDCCGGKGRGKCYGPQCLCR |
| SEQ ID NO: 682 | MCMPCFTTDHQMARKCDDCCGGAGRGKCYGPQCLCR |
| SEQ ID NO: 683 | MCMPCFTTDHQMARACDDCCGGAGRGKCYGPQCLCR |
| SEQ ID NO: 684 | MCMPCFTTDHQMARRCDDCCGGAGRGKCYGPQCLCR |
| SEQ ID NO: 685 | MCMPCFTTDHQMARKCDDCCGGRGRGKCYGPQCLCR |
| SEQ ID NO: 686 | MCMPCFTTDHQMARACDDCCGGRGRGKCYGPQCLCR |
| SEQ ID NO: 687 | MCMPCFTTDHQMARKCDDCCGGKGRGACYGPQCLCR |
| SEQ ID NO: 688 | MCMPCFTTDHQMARACDDCCGGKGRGACYGPQCLCR |
| SEQ ID NO: 689 | MCMPCFTTDHQMARRCDDCCGGKGRGACYGPQCLCR |
| SEQ ID NO: 690 | MCMPCFTTDHQMARKCDDCCGGAGRGACYGPQCLCR |
| SEQ ID NO: 691 | MCMPCFTTDHQMARACDDCCGGAGRGACYGPQCLCR |
| SEQ ID NO: 692 | MCMPCFTTDHQMARRCDDCCGGAGRGACYGPQCLCR |
| SEQ ID NO: 693 | MCMPCFTTDHQMARKCDDCCGGRGRGACYGPQCLCR |
| SEQ ID NO: 694 | MCMPCFTTDHQMARACDDCCGGRGRGACYGPQCLCR |

TABLE 1-continued

Peptide Sequences

| SEQ ID NO | Sequence |
|---|---|
| SEQ ID NO: 695 | MCMPCFTTDHQMARRCDDCCGGRGRGACYGPQCLCR |
| SEQ ID NO: 696 | MCMPCFTTDHQMARKCDDCCGGKGRGRCYGPQCLCR |
| SEQ ID NO: 697 | MCMPCFTTDHQMARACDDCCGGKGRGRCYGPQCLCR |
| SEQ ID NO: 698 | MCMPCFTTDHQMARKCDDCCGGAGRGRCYGPQCLCR |
| SEQ ID NO: 699 | MCMPCFTTDHQMARACDDCCGGAGRGRCYGPQCLCR |
| SEQ ID NO: 700 | MCMPCFTTDHQMARRCDDCCGGAGRGRCYGPQCLCR |
| SEQ ID NO: 701 | MCMPCFTTDHQMARACDDCCGGRGRGRCYGPQCLCR |
| SEQ ID NO: 702 | KCNIPCFTTDHQMARRCDDCCGGRGRGRCYGPQCLCR |
| SEQ ID NO: 703 | ACAPCFTTDHQAARRCDDCCGGRGRGRCYGPQCLCR |
| SEQ ID NO: 704 | KCAPCFTTDHQAARRCDDCCGGRGRGRCYGPQCLCR |
| SEQ ID NO: 705 | MCMPCFTTDHQMAR(Cit)CDDCCGG(Cit)GRGKCYGPQCLCR |
| SEQ ID NO: 706 | MCMPCFTTDHQMAR(Cit)CDDCCGG(Cit)GRG(Cit)CYGPQCLCR |
| SEQ ID NO: 707 | KCNIPCFTTDHQMAR(Cit)CDDCCGG(Cit)GRG(Cit)CYGPQCLCR |
| SEQ ID NO: 708 | ACAPCFTTDHQAAR(Cit)CDDCCGG(Cit)GRGKCYGPQCLCR |
| SEQ ID NO: 709 | ACAPCFTTDHQAAR(Cit)CDDCCGG(Cit)GRG(Cit)CYGPQCLCR |
| SEQ ID NO: 710 | KCAPCFTTDHQAAR(Cit)CDDCCGG(Cit)GRG(Cit)CYGPQCLCR |
| SEQ ID NO: 711 | MCMPCFTTDHQMARKCDDCCGGKGRGKCYGPQCLCRGAGAAGG |
| SEQ ID NO: 712 | MCMPCFTTDHQMARACDDCCGGKGRGKCYGPQCLCRGAGAAGG |
| SEQ ID NO: 713 | MCMPCFTTDHQMARRCDDCCGGKGRGKCYGPQCLCRGAGAAGG |
| SEQ ID NO: 714 | MCMPCFTTDHQMARKCDDCCGGAGRGKCYGPQCLCRGAGAAGG |
| SEQ ID NO: 715 | MCMPCFTTDHQMARACDDCCGGAGRGKCYGPQCLCRGAGAAGG |
| SEQ ID NO: 716 | MCMPCFTTDHQMARRCDDCCGGAGRGKCYGPQCLCRGAGAAGG |
| SEQ ID NO: 717 | MCMPCFTTDHQMARKCDDCCGGRGRGKCYGPQCLCRGAGAAGG |
| SEQ ID NO: 718 | MCMPCFTTDHQMARACDDCCGGRGRGKCYGPQCLCRGAGAAGG |
| SEQ ID NO: 719 | MCMPCFTTDHQMARRCDDCCGGRGRGKCYGPQCLCRGAGAAGG |
| SEQ ID NO: 720 | MCMPCFTTDHQMARKCDDCCGGKGRGACYGPQCLCRGAGAAGG |
| SEQ ID NO: 721 | MCMPCFTTDHQMARACDDCCGGKGRGACYGPQCLCRGAGAAGG |
| SEQ ID NO: 722 | MCMPCFTTDHQMARRCDDCCGGKGRGACYGPQCLCRGAGAAGG |
| SEQ ID NO: 723 | MCMPCFTTDHQMARKCDDCCGGAGRGACYGPQCLCRGAGAAGG |
| SEQ ID NO: 724 | MCMPCFTTDHQMARACDDCCGGAGRGACYGPQCLCRGAGAAGG |

TABLE 1-continued

Peptide Sequences

| SEQ ID NO | Sequence |
|---|---|
| SEQ ID NO: 725 | MCMPCFTTDHQMARRCDDCCGGAGRGACYGPQCLCRGAGAAGG |
| SEQ ID NO: 726 | MCMPCFTTDHQMARKCDDCCGGRGRGACYGPQCLCRGAGAAGG |
| SEQ ID NO: 727 | MCMPCFTTDHQMARACDDCCGGRGRGACYGPQCLCRGAGAAGG |
| SEQ ID NO: 728 | MCMPCFTTDHQMARRCDDCCGGRGRGACYGPQCLCRGAGAAGG |
| SEQ ID NO: 729 | MCMPCFTTDHQMARKCDDCCGGKGRGRCYGPQCLCRGAGAAGG |
| SEQ ID NO: 730 | MCMPCFTTDHQMARACDDCCGGKGRGRCYGPQCLCRGAGAAGG |
| SEQ ID NO: 731 | MCMPCFTTDHQMARRCDDCCGGKGRGRCYGPQCLCRGAGAAGG |
| SEQ ID NO: 732 | MCMPCFTTDHQMARKCDDCCGGAGRGRCYGPQCLCRGAGAAGG |
| SEQ ID NO: 733 | MCMPCFTTDHQMARACDDCCGGAGRGRCYGPQCLCRGAGAAGG |
| SEQ ID NO: 734 | MCMPCFTTDHQMARRCDDCCGGAGRGRCYGPQCLCRGAGAAGG |
| SEQ ID NO: 735 | MCMPCFTTDHQMARKCDDCCGGRGRGRCYGPQCLCRGAGAAGG |
| SEQ ID NO: 736 | MCMPCFTTDHQMARACDDCCGGRGRGRCYGPQCLCRGAGAAGG |
| SEQ ID NO: 737 | MCMPCFTTDHQMARRCDDCCGGRGRGRCYGPQCLCRGAGAAGG |
| SEQ ID NO: 738 | KCMPCFTTDHQMARRCDDCCGGRGRGRCYGPQCLCRGAGAAGG |
| SEQ ID NO: 739 | ACAPCFTTDHQAARRCDDCCGGRGRGRCYGPQCLCRGAGAAGG |
| SEQ ID NO: 740 | KCAPCFTTDHQAARRCDDCCGGRGRGRCYGPQCLCRGAGAAGG |
| SEQ ID NO: 741 | MCMPCFTTDHQMAR(Cit)CDDCCGG(Cit)GRGKCYGPQCLCRGAGAAGG |
| SEQ ID NO: 742 | MCMPCFTTDHQMAR(Cit)CDDCCGG(Cit)GRG(Cit)CYGPQCLCRGAGAAGG |
| SEQ ID NO: 743 | KCMPCFTTDHQMAR(Cit)CDDCCGG(Cit)GRG(Cit)CYGPQCLCRGAGAAGG |
| SEQ ID NO: 744 | ACAPCFTTDHQAAR(Cit)CDDCCGG(Cit)GRGKCYGPQCLCRGAGAAGG |
| SEQ ID NO: 745 | ACAPCFTTDHQAAR(Cit)CDDCCGG(Cit)GRG(Cit)CYGPQCLCRGAGAAGG |
| SEQ ID NO: 746 | KCAPCFTTDHQAAR(Cit)CDDCCGG(Cit)GRG(Cit)CYGPQCLCRGAGAAGG |
| SEQ ID NO: 747 | MCMPCFTTDHQMVRKCDDCCGGKGRGKCYGPQCLCR |
| SEQ ID NO: 748 | MCMPCFTTDHQMVRVCDDCCGGKGRGKCYGPQCLCR |
| SEQ ID NO: 749 | MCMPCFTTDHQMVRRCDDCCGGKGRGKCYGPQCLCR |
| SEQ ID NO: 750 | MCMPCFTTDHQMVRKCDDCCGGVGRGKCYGPQCLCR |
| SEQ ID NO: 751 | MCMPCFTTDHQMVRVCDDCCGGVGRGKCYGPQCLCR |
| SEQ ID NO: 752 | MCMPCFTTDHQMVRRCDDCCGGVGRGKCYGPQCLCR |

TABLE 1-continued

Peptide Sequences

| SEQ ID NO | Sequence |
| --- | --- |
| SEQ ID NO: 753 | MCMPCFTTDHQMVRKCDDCCGGRGRGKCYGPQCLCR |
| SEQ ID NO: 754 | MCMPCFTTDHQMVRVCDDCCGGRGRGKCYGPQCLCR |
| SEQ ID NO: 755 | MCMPCFTTDHQMVRRCDDCCGGRGRGKCYGPQCLCR |
| SEQ ID NO: 756 | MCMPCFTTDHQMVRKCDDCCGGKGRGVCYGPQCLCR |
| SEQ ID NO: 757 | MCMPCFTTDHQMVRVCDDCCGGKGRGVCYGPQCLCR |
| SEQ ID NO: 758 | MCMPCFTTDHQMVRRCDDCCGGKGRGVCYGPQCLCR |
| SEQ ID NO: 759 | MCMPCFTTDHQMVRKCDDCCGGVGRGVCYGPQCLCR |
| SEQ ID NO: 760 | MCMPCFTTDHQMVRVCDDCCGGVGRGVCYGPQCLCR |
| SEQ ID NO: 761 | MCMPCFTTDHQMVRRCDDCCGGVGRGVCYGPQCLCR |
| SEQ ID NO: 762 | MCMPCFTTDHQMVRKCDDCCGGRGRGVCYGPQCLCR |
| SEQ ID NO: 763 | MCMPCFTTDHQMVRVCDDCCGGRGRGVCYGPQCLCR |
| SEQ ID NO: 764 | MCMPCFTTDHQMVRRCDDCCGGRGRGVCYGPQCLCR |
| SEQ ID NO: 765 | MCMPCFTTDHQMVRKCDDCCGGKGRGRCYGPQCLCR |
| SEQ ID NO: 766 | MCMPCFTTDHQMVRVCDDCCGGKGRGRCYGPQCLCR |
| SEQ ID NO: 767 | MCMPCFTTDHQMVRRCDDCCGGKGRGRCYGPQCLCR |
| SEQ ID NO: 768 | MCMPCFTTDHQMVRKCDDCCGGVGRGRCYGPQCLCR |
| SEQ ID NO: 769 | MCMPCFTTDHQMVRVCDDCCGGVGRGRCYGPQCLCR |
| SEQ ID NO: 770 | MCMPCFTTDHQMVRRCDDCCGGVGRGRCYGPQCLCR |
| SEQ ID NO: 771 | MCMPCFTTDHQMVRKCDDCCGGRGRGRCYGPQCLCR |
| SEQ ID NO: 772 | MCMPCFTTDHQMVRVCDDCCGGRGRGRCYGPQCLCR |
| SEQ ID NO: 773 | MCMPCFTTDHQMVRRCDDCCGGRGRGRCYGPQCLCR |
| SEQ ID NO: 774 | KCNIPCFTTDHQMVRRCDDCCGGRGRGRCYGPQCLCR |
| SEQ ID NO: 775 | VCVPCFTTDHQVVRRCDDCCGGRGRGRCYGPQCLCR |
| SEQ ID NO: 776 | KCVPCFTTDHQVVRRCDDCCGGRGRGRCYGPQCLCR |
| SEQ ID NO: 777 | MCMPCFTTDHQMVR(Cit)CDDCCGG(Cit)GRGKCYGPQCLCR |
| SEQ ID NO: 778 | MCMPCFTTDHQMVR(Cit)CDDCCGG(Cit)GRG(Cit)CYGPQCLCR |
| SEQ ID NO: 779 | KCNIPCFTTDHQMVR(Cit)CDDCCGG(Cit)GRG(Cit)CYGPQCLCR |
| SEQ ID NO: 780 | VCVPCFTTDHQVVR(Cit)CDDCCGG(Cit)GRGKCYGPQCLCR |
| SEQ ID NO: 781 | VCVPCFTTDHQVVR(Cit)CDDCCGG(Cit)GRG(Cit)CYGPQCLCR |
| SEQ ID NO: 782 | KCVPCFTTDHQVVR(Cit)CDDCCGG(Cit)GRG(Cit)CYGPQCLCR |
| SEQ ID NO: 783 | MCMPCFTTDHQMVRKCDDCCGGKGRGKCYGPQCLCRGAGAAGG |
| SEQ ID NO: 784 | MCMPCFTTDHQMVRVCDDCCGGKGRGKCYGPQCLCRGAGAAGG |
| SEQ ID NO: 785 | MCMPCFTTDHQMVRRCDDCCGGKGRGKCYGPQCLCRGAGAAGG |
| SEQ ID NO: 786 | MCMPCFTTDHQMVRKCDDCCGGVGRGKCYGPQCLCRGAGAAGG |
| SEQ ID NO: 787 | MCMPCFTTDHQMVRVCDDCCGGVGRGKCYGPQCLCRGAGAAGG |

TABLE 1-continued

Peptide Sequences

| SEQ ID NO | Sequence |
|---|---|
| SEQ ID NO: 788 | MCMPCFTTDHQMVRRCDDCCGGVGRGKCYGPQCLCRGAGAAGG |
| SEQ ID NO: 789 | MCMPCFTTDHQMVRKCDDCCGGRGRGKCYGPQCLCRGAGAAGG |
| SEQ ID NO: 790 | MCMPCFTTDHQMVRVCDDCCGGRGRGKCYGPQCLCRGAGAAGG |
| SEQ ID NO: 791 | MCMPCFTTDHQMVRRCDDCCGGRGRGKCYGPQCLCRGAGAAGG |
| SEQ ID NO: 792 | MCMPCFTTDHQMVRKCDDCCGGKGRGVCYGPQCLCRGAGAAGG |
| SEQ ID NO: 793 | MCMPCFTTDHQMVRVCDDCCGGKGRGVCYGPQCLCRGAGAAGG |
| SEQ ID NO: 794 | MCMPCFTTDHQMVRRCDDCCGGKGRGVCYGPQCLCRGAGAAGG |
| SEQ ID NO: 795 | MCMPCFTTDHQMVRKCDDCCGGVGRGVCYGPQCLCRGAGAAGG |
| SEQ ID NO: 796 | MCMPCFTTDHQMVRVCDDCCGGVGRGVCYGPQCLCRGAGAAGG |
| SEQ ID NO: 797 | MCMPCFTTDHQMVRRCDDCCGGVGRGVCYGPQCLCRGAGAAGG |
| SEQ ID NO: 798 | MCMPCFTTDHQMVRKCDDCCGGRGRGVCYGPQCLCRGAGAAGG |
| SEQ ID NO: 799 | MCMPCFTTDHQMVRVCDDCCGGRGRGVCYGPQCLCRGAGAAGG |
| SEQ ID NO: 800 | MCMPCFTTDHQMVRRCDDCCGGRGRGVCYGPQCLCRGAGAAGG |
| SEQ ID NO: 801 | MCMPCFTTDHQMVRKCDDCCGGKGRGRCYGPQCLCRGAGAAGG |
| SEQ ID NO: 802 | MCMPCFTTDHQMVRVCDDCCGGKGRGRCYGPQCLCRGAGAAGG |
| SEQ ID NO: 803 | MCMPCFTTDHQMVRRCDDCCGGKGRGRCYGPQCLCRGAGAAGG |
| SEQ ID NO: 804 | MCMPCFTTDHQMVRKCDDCCGGVGRGRCYGPQCLCRGAGAAGG |
| SEQ ID NO: 805 | MCMPCFTTDHQMVRVCDDCCGGVGRGRCYGPQCLCRGAGAAGG |
| SEQ ID NO: 806 | MCMPCFTTDHQMVRRCDDCCGGVGRGRCYGPQCLCRGAGAAGG |
| SEQ ID NO: 807 | MCMPCFTTDHQMVRKCDDCCGGRGRGRCYGPQCLCRGAGAAGG |
| SEQ ID NO: 808 | MCMPCFTTDHQMVRVCDDCCGGRGRGRCYGPQCLCRGAGAAGG |
| SEQ ID NO: 809 | MCMPCFTTDHQMVRRCDDCCGGRGRGRCYGPQCLCRGAGAAGG |
| SEQ ID NO: 810 | KCNIPCFTTDHQMVRRCDDCCGGRGRGRCYGPQCLCRGAGAAGG |
| SEQ ID NO: 811 | VCVPCFTTDHQVVRRCDDCCGGRGRGRCYGPQCLCRGAGAAGG |
| SEQ ID NO: 812 | KCVPCFTTDHQVVRRCDDCCGGRGRGRCYGPQCLCRGAGAAGG |
| SEQ ID NO: 813 | MCMPCFTTDHQMVR(Cit)CDDCCGG(Cit)GRGKCYGPQCLCRGAGAAGG |

TABLE 1-continued

Peptide Sequences

| SEQ ID NO | Sequence |
|---|---|
| SEQ ID NO: 814 | MCMPCFTTDHQMVR(Cit)CDDCCGG(Cit)GRG(Cit)CYGPQCLCRGAGAAGG |
| SEQ ID NO: 815 | KCNIPCFTTDHQMVR(Cit)CDDCCGG(Cit)GRG(Cit)CYGPQCLCRGAGAAGG |
| SEQ ID NO: 816 | VCVPCFTTDHQVVR(Cit)CDDCCGG(Cit)GRGKCYGPQCLCRGAGAAGG |
| SEQ ID NO: 817 | VCVPCFTTDHQVVR(Cit)CDDCCGG(Cit)GRG(Cit)CYGPQCLCRGAGAAGG |
| SEQ ID NO: 818 | KCVPCFTTDHQVVR(Cit)CDDCCGG(Cit)GRG(Cit)CYGPQCLCRGAGAAGG |
| SEQ ID NO: 819 | MCMPCFTTDHQMLRKCDDCCGGKGRGKCYGPQCLCR |
| SEQ ID NO: 820 | MCMPCFTTDHQMLRLCDDCCGGKGRGKCYGPQCLCR |
| SEQ ID NO: 821 | MCMPCFTTDHQMLRRCDDCCGGKGRGKCYGPQCLCR |
| SEQ ID NO: 822 | MCMPCFTTDHQMLRKCDDCCGGLGRGKCYGPQCLCR |
| SEQ ID NO: 823 | MCMPCFTTDHQMLRLCDDCCGGLGRGKCYGPQCLCR |
| SEQ ID NO: 824 | MCMPCFTTDHQMLRRCDDCCGGLGRGKCYGPQCLCR |
| SEQ ID NO: 825 | MCMPCFTTDHQMLRKCDDCCGGRGRGKCYGPQCLCR |
| SEQ ID NO: 826 | MCMPCFTTDHQMLRLCDDCCGGRGRGKCYGPQCLCR |
| SEQ ID NO: 827 | MCMPCFTTDHQMLRRCDDCCGGRGRGKCYGPQCLCR |
| SEQ ID NO: 828 | MCMPCFTTDHQMLRKCDDCCGGKGRGLCYGPQCLCR |
| SEQ ID NO: 829 | MCMPCFTTDHQMLRLCDDCCGGKGRGLCYGPQCLCR |
| SEQ ID NO: 830 | MCMPCFTTDHQMLRRCDDCCGGKGRGLCYGPQCLCR |
| SEQ ID NO: 831 | MCMPCFTTDHQMLRKCDDCCGGLGRGLCYGPQCLCR |
| SEQ ID NO: 832 | MCMPCFTTDHQMLRLCDDCCGGLGRGLCYGPQCLCR |
| SEQ ID NO: 833 | MCMPCFTTDHQMLRRCDDCCGGLGRGLCYGPQCLCR |
| SEQ ID NO: 834 | MCMPCFTTDHQMLRKCDDCCGGRGRGLCYGPQCLCR |
| SEQ ID NO: 835 | MCMPCFTTDHQMLRLCDDCCGGRGRGLCYGPQCLCR |
| SEQ ID NO: 836 | MCMPCFTTDHQMLRRCDDCCGGRGRGLCYGPQCLCR |
| SEQ ID NO: 837 | MCMPCFTTDHQMLRKCDDCCGGKGRGRCYGPQCLCR |
| SEQ ID NO: 838 | MCMPCFTTDHQMLRLCDDCCGGKGRGRCYGPQCLCR |
| SEQ ID NO: 839 | MCMPCFTTDHQMLRRCDDCCGGKGRGRCYGPQCLCR |
| SEQ ID NO: 840 | MCMPCFTTDHQMLRKCDDCCGGLGRGRCYGPQCLCR |
| SEQ ID NO: 841 | MCMPCFTTDHQMLRLCDDCCGGLGRGRCYGPQCLCR |
| SEQ ID NO: 842 | MCMPCFTTDHQMLRRCDDCCGGLGRGRCYGPQCLCR |
| SEQ ID NO: 843 | MCMPCFTTDHQMLRKCDDCCGGRGRGRCYGPQCLCR |
| SEQ ID NO: 844 | MCMPCFTTDHQMLRLCDDCCGGRGRGRCYGPQCLCR |
| SEQ ID NO: 845 | MCMPCFTTDHQMLRRCDDCCGGRGRGRCYGPQCLCR |
| SEQ ID NO: 846 | KCNIPCFTTDHQMLRRCDDCCGGRGRGRCYGPQCLCR |
| SEQ ID NO: 847 | LCLPCFTTDHQLLRRCDDCCGGRGRGRCYGPQCLCR |
| SEQ ID NO: 848 | KCLPCFTTDHQLLRRCDDCCGGRGRGRCYGPQCLCR |

TABLE 1-continued

Peptide Sequences

| SEQ ID NO | Sequence |
|---|---|
| SEQ ID NO: 849 | MCMPCFTTDHQMLR(Cit)CDDCCGG(Cit)GRGKCYGPQCLCR |
| SEQ ID NO: 850 | MCMPCFTTDHQMLR(Cit)CDDCCGG(Cit)GRG(Cit)CYGPQCLCR |
| SEQ ID NO: 851 | KCNIPCFTTDHQMLR(Cit)CDDCCGG(Cit)GRG(Cit)CYGPQCLCR |
| SEQ ID NO: 852 | LCLPCFTTDHQLLR(Cit)CDDCCGG(Cit)GRGKCYGPQCLCR |
| SEQ ID NO: 853 | LCLPCFTTDHQLLR(Cit)CDDCCGG(Cit)GRG(Cit)CYGPQCLCR |
| SEQ ID NO: 854 | KCLPCFTTDHQLLR(Cit)CDDCCGG(Cit)GRG(Cit)CYGPQCLCR |
| SEQ ID NO: 855 | MCMPCFTTDHQMLRKCDDCCGGKGRGKCYGPQCLCRGAGAAGG |
| SEQ ID NO: 856 | MCMPCFTTDHQMLRLCDDCCGGKGRGKCYGPQCLCRGAGAAGG |
| SEQ ID NO: 857 | MCMPCFTTDHQMLRRCDDCCGGKGRGKCYGPQCLCRGAGAAGG |
| SEQ ID NO: 858 | MCMPCFTTDHQMLRKCDDCCGGLGRGKCYGPQCLCRGAGAAGG |
| SEQ ID NO: 859 | MCMPCFTTDHQMLRLCDDCCGGLGRGKCYGPQCLCRGAGAAGG |
| SEQ ID NO: 860 | MCMPCFTTDHQMLRRCDDCCGGLGRGKCYGPQCLCRGAGAAGG |
| SEQ ID NO: 861 | MCMPCFTTDHQMLRKCDDCCGGRGRGKCYGPQCLCRGAGAAGG |
| SEQ ID NO: 862 | MCMPCFTTDHQMLRLCDDCCGGRGRGKCYGPQCLCRGAGAAGG |
| SEQ ID NO: 863 | MCMPCFTTDHQMLRRCDDCCGGRGRGKCYGPQCLCRGAGAAGG |
| SEQ ID NO: 864 | MCMPCFTTDHQMLRKCDDCCGGKGRGLCYGPQCLCRGAGAAGG |
| SEQ ID NO: 865 | MCMPCFTTDHQMLRLCDDCCGGKGRGLCYGPQCLCRGAGAAGG |
| SEQ ID NO: 866 | MCMPCFTTDHQMLRRCDDCCGGKGRGLCYGPQCLCRGAGAAGG |
| SEQ ID NO: 867 | MCMPCFTTDHQMLRKCDDCCGGLGRGLCYGPQCLCRGAGAAGG |
| SEQ ID NO: 868 | MCMPCFTTDHQMLRLCDDCCGGLGRGLCYGPQCLCRGAGAAGG |
| SEQ ID NO: 869 | MCMPCFTTDHQMLRRCDDCCGGLGRGLCYGPQCLCRGAGAAGG |
| SEQ ID NO: 870 | MCMPCFTTDHQMLRKCDDCCGGRGRGLCYGPQCLCRGAGAAGG |
| SEQ ID NO: 871 | MCMPCFTTDHQMLRLCDDCCGGRGRGLCYGPQCLCRGAGAAGG |
| SEQ ID NO: 872 | MCMPCFTTDHQMLRRCDDCCGGRGRGLCYGPQCLCRGAGAAGG |
| SEQ ID NO: 873 | MCMPCFTTDHQMLRKCDDCCGGKGRGRCYGPQCLCRGAGAAGG |
| SEQ ID NO: 874 | MCMPCFTTDHQMLRLCDDCCGGKGRGRCYGPQCLCRGAGAAGG |
| SEQ ID NO: 875 | MCMPCFTTDHQMLRRCDDCCGGKGRGRCYGPQCLCRGAGAAGG |

TABLE 1-continued

Peptide Sequences

| SEQ ID NO | Sequence |
|---|---|
| SEQ ID NO: 876 | MCMPCFTTDHQMLRKCDDCCGGLGRGRCYGPQCLCRGAGAAGG |
| SEQ ID NO: 877 | MCMPCFTTDHQMLRLCDDCCGGLGRGRCYGPQCLCRGAGAAGG |
| SEQ ID NO: 878 | MCMPCFTTDHQMLRRCDDCCGGLGRGRCYGPQCLCRGAGAAGG |
| SEQ ID NO: 879 | MCMPCFTTDHQMLRKCDDCCGGRGRGRCYGPQCLCRGAGAAGG |
| SEQ ID NO: 880 | MCMPCFTTDHQMLRLCDDCCGGRGRGRCYGPQCLCRGAGAAGG |
| SEQ ID NO: 881 | MCMPCFTTDHQMLRRCDDCCGGRGRGRCYGPQCLCRGAGAAGG |
| SEQ ID NO: 882 | KCMPCFTTDHQMLRRCDDCCGGRGRGRCYGPQCLCRGAGAAGG |
| SEQ ID NO: 883 | LCLPCFTTDHQLLRRCDDCCGGRGRGRCYGPQCLCRGAGAAGG |
| SEQ ID NO: 884 | KCLPCFTTDHQLLRRCDDCCGGRGRGRCYGPQCLCRGAGAAGG |
| SEQ ID NO: 885 | MCMPCFTTDHQMLR(Cit)CDDCCGG(Cit)GRGKCYGPQCLCRGAGAAGG |
| SEQ ID NO: 886 | MCMPCFTTDHQMLR(Cit)CDDCCGG(Cit)GRG(Cit)CYGPQCLCRGAGAAGG |
| SEQ ID NO: 887 | KCNIPCFTTDHQMLR(Cit)CDDCCGG(Cit)GRG(Cit)CYGPQCLCRGAGAAGG |
| SEQ ID NO: 888 | LCLPCFTTDHQLLR(Cit)CDDCCGG(Cit)GRGKCYGPQCLCRGAGAAGG |
| SEQ ID NO: 889 | LCLPCFTTDHQLLR(Cit)CDDCCGG(Cit)GRG(Cit)CYGPQCLCRGAGAAGG |
| SEQ ID NO: 890 | KCLPCFTTDHQLLR(Cit)CDDCCGG(Cit)GRG(Cit)CYGPQCLCRGAGAAGG |
| SEQ ID NO: 891 | GCGPCFTTDHQGARKCDDCCGGKGRGKCYGPQCLCR |
| SEQ ID NO: 892 | GCGPCFTTDHQGARACDDCCGGKGRGKCYGPQCLCR |
| SEQ ID NO: 893 | GCGPCFTTDHQGARRCDDCCGGKGRGKCYGPQCLCR |
| SEQ ID NO: 894 | GCGPCFTTDHQGARKCDDCCGGAGRGKCYGPQCLCR |
| SEQ ID NO: 895 | GCGPCFTTDHQGARACDDCCGGAGRGKCYGPQCLCR |
| SEQ ID NO: 896 | GCGPCFTTDHQGARRCDDCCGGAGRGKCYGPQCLCR |
| SEQ ID NO: 897 | GCGPCFTTDHQGARKCDDCCGGRGRGKCYGPQCLCR |
| SEQ ID NO: 898 | GCGPCFTTDHQGARACDDCCGGRGRGKCYGPQCLCR |
| SEQ ID NO: 899 | GCGPCFTTDHQGARRCDDCCGGRGRGKCYGPQCLCR |
| SEQ ID NO: 900 | GCGPCFTTDHQGARKCDDCCGGKGRGACYGPQCLCR |
| SEQ ID NO: 901 | GCGPCFTTDHQGARACDDCCGGKGRGACYGPQCLCR |
| SEQ ID NO: 902 | GCGPCFTTDHQGARRCDDCCGGKGRGACYGPQCLCR |
| SEQ ID NO: 903 | GCGPCFTTDHQGARKCDDCCGGAGRGACYGPQCLCR |
| SEQ ID NO: 904 | GCGPCFTTDHQGARACDDCCGGAGRGACYGPQCLCR |
| SEQ ID NO: 905 | GCGPCFTTDHQGARRCDDCCGGAGRGACYGPQCLCR |
| SEQ ID NO: 906 | GCGPCFTTDHQGARKCDDCCGGRGRGACYGPQCLCR |
| SEQ ID NO: 907 | GCGPCFTTDHQGARACDDCCGGRGRGACYGPQCLCR |

TABLE 1-continued

Peptide Sequences

| SEQ ID NO | Sequence |
| --- | --- |
| SEQ ID NO: 908 | GCGPCFTTDHQGARRCDDCCGGRGRGACYGPQCLCR |
| SEQ ID NO: 909 | GCGPCFTTDHQGARKCDDCCGGKGRGRCYGPQCLCR |
| SEQ ID NO: 910 | GCGPCFTTDHQGARACDDCCGGKGRGRCYGPQCLCR |
| SEQ ID NO: 911 | GCGPCFTTDHQGARRCDDCCGGKGRGRCYGPQCLCR |
| SEQ ID NO: 912 | GCGPCFTTDHQGARKCDDCCGGAGRGRCYGPQCLCR |
| SEQ ID NO: 913 | GCGPCFTTDHQGARACDDCCGGAGRGRCYGPQCLCR |
| SEQ ID NO: 914 | GCGPCFTTDHQGARRCDDCCGGAGRGRCYGPQCLCR |
| SEQ ID NO: 915 | GCGPCFTTDHQGARKCDDCCGGRGRGRCYGPQCLCR |
| SEQ ID NO: 916 | GCGPCFTTDHQGARACDDCCGGRGRGRCYGPQCLCR |
| SEQ ID NO: 917 | GCGPCFTTDHQGARRCDDCCGGRGRGRCYGPQCLCR |
| SEQ ID NO: 918 | KCGPCFTTDHQGARRCDDCCGGRGRGRCYGPQCLCR |
| SEQ ID NO: 919 | GCGPCFTTDHQGAR(Cit)CDDCCGG(Cit)GRGKCYGPQCLCR |
| SEQ ID NO: 920 | GCGPCFTTDHQGAR(Cit)CDDCCGG(Cit)GRG(Cit)CYGPQCLCR |
| SEQ ID NO: 921 | KCGPCFTTDHQGAR(Cit)CDDCCGG(Cit)GRG(Cit)CYGPQCLCR |
| SEQ ID NO: 922 | ACAPCFTTDHQAARACDDCCGGKGRGKCYGPQCLCR |
| SEQ ID NO: 923 | ACAPCFTTDHQAARRCDDCCGGKGRGKCYGPQCLCR |
| SEQ ID NO: 924 | ACAPCFTTDHQAARKCDDCCGGAGRGKCYGPQCLCR |
| SEQ ID NO: 925 | ACAPCFTTDHQAARACDDCCGGAGRGKCYGPQCLCR |
| SEQ ID NO: 926 | ACAPCFTTDHQAARRCDDCCGGAGRGKCYGPQCLCR |
| SEQ ID NO: 927 | ACAPCFTTDHQAARKCDDCCGGRGRGKCYGPQCLCR |
| SEQ ID NO: 928 | ACAPCFTTDHQAARACDDCCGGRGRGKCYGPQCLCR |
| SEQ ID NO: 929 | ACAPCFTTDHQAARKCDDCCGGKGRGACYGPQCLCR |
| SEQ ID NO: 930 | ACAPCFTTDHQAARACDDCCGGKGRGACYGPQCLCR |
| SEQ ID NO: 931 | ACAPCFTTDHQAARRCDDCCGGKGRGACYGPQCLCR |
| SEQ ID NO: 932 | ACAPCFTTDHQAARKCDDCCGGAGRGACYGPQCLCR |
| SEQ ID NO: 933 | ACAPCFTTDHQAARACDDCCGGAGRGACYGPQCLCR |
| SEQ ID NO: 934 | ACAPCFTTDHQAARRCDDCCGGAGRGACYGPQCLCR |
| SEQ ID NO: 935 | ACAPCFTTDHQAARKCDDCCGGRGRGACYGPQCLCR |
| SEQ ID NO: 936 | ACAPCFTTDHQAARACDDCCGGRGRGACYGPQCLCR |
| SEQ ID NO: 937 | ACAPCFTTDHQAARRCDDCCGGRGRGACYGPQCLCR |
| SEQ ID NO: 938 | ACAPCFTTDHQAARKCDDCCGGKGRGRCYGPQCLCR |
| SEQ ID NO: 939 | ACAPCFTTDHQAARACDDCCGGKGRGRCYGPQCLCR |
| SEQ ID NO: 940 | ACAPCFTTDHQAARRCDDCCGGKGRGRCYGPQCLCR |
| SEQ ID NO: 941 | ACAPCFTTDHQAARKCDDCCGGAGRGRCYGPQCLCR |
| SEQ ID NO: 942 | ACAPCFTTDHQAARACDDCCGGAGRGRCYGPQCLCR |
| SEQ ID NO: 943 | ACAPCFTTDHQAARRCDDCCGGAGRGRCYGPQCLCR |
| SEQ ID NO: 944 | ACAPCFTTDHQAARKCDDCCGGRGRGRCYGPQCLCR |
| SEQ ID NO: 945 | ACAPCFTTDHQAARACDDCCGGRGRGRCYGPQCLCR |

TABLE 1-continued

Peptide Sequences

| SEQ ID NO | Sequence |
|---|---|
| SEQ ID NO: 946 | ICIPCFTTDHQIARKCDDCCGGKGRGKCYGPQCLCR |
| SEQ ID NO: 947 | ICIPCFTTDHQIARACDDCCGGKGRGKCYGPQCLCR |
| SEQ ID NO: 948 | ICIPCFTTDHQIARRCDDCCGGKGRGKCYGPQCLCR |
| SEQ ID NO: 949 | ICIPCFTTDHQIARKCDDCCGGAGRGKCYGPQCLCR |
| SEQ ID NO: 950 | ICIPCFTTDHQIARACDDCCGGAGRGKCYGPQCLCR |
| SEQ ID NO: 951 | ICIPCFTTDHQIARRCDDCCGGAGRGKCYGPQCLCR |
| SEQ ID NO: 952 | ICIPCFTTDHQIARKCDDCCGGRGRGKCYGPQCLCR |
| SEQ ID NO: 953 | ICIPCFTTDHQIARACDDCCGGRGRGKCYGPQCLCR |
| SEQ ID NO: 954 | ICIPCFTTDHQIARKCDDCCGGKGRGACYGPQCLCR |
| SEQ ID NO: 955 | ICIPCFTTDHQIARACDDCCGGKGRGACYGPQCLCR |
| SEQ ID NO: 956 | ICIPCFTTDHQIARRCDDCCGGKGRGACYGPQCLCR |
| SEQ ID NO: 957 | ICIPCFTTDHQIARKCDDCCGGAGRGACYGPQCLCR |
| SEQ ID NO: 958 | ICIPCFTTDHQIARACDDCCGGAGRGACYGPQCLCR |
| SEQ ID NO: 959 | ICIPCFTTDHQIARRCDDCCGGAGRGACYGPQCLCR |
| SEQ ID NO: 960 | ICIPCFTTDHQIARKCDDCCGGRGRGACYGPQCLCR |
| SEQ ID NO: 961 | ICIPCFTTDHQIARACDDCCGGRGRGACYGPQCLCR |
| SEQ ID NO: 962 | ICIPCFTTDHQIARRCDDCCGGRGRGACYGPQCLCR |
| SEQ ID NO: 963 | ICIPCFTTDHQIARKCDDCCGGKGRGRCYGPQCLCR |
| SEQ ID NO: 964 | ICIPCFTTDHQIARACDDCCGGKGRGRCYGPQCLCR |
| SEQ ID NO: 965 | ICIPCFTTDHQIARRCDDCCGGKGRGRCYGPQCLCR |
| SEQ ID NO: 966 | ICIPCFTTDHQIARKCDDCCGGAGRGRCYGPQCLCR |
| SEQ ID NO: 967 | ICIPCFTTDHQIARACDDCCGGAGRGRCYGPQCLCR |
| SEQ ID NO: 968 | ICIPCFTTDHQIARRCDDCCGGAGRGRCYGPQCLCR |
| SEQ ID NO: 969 | ICIPCFTTDHQIARKCDDCCGGRGRGRCYGPQCLCR |
| SEQ ID NO: 970 | ICIPCFTTDHQIARACDDCCGGRGRGRCYGPQCLCR |
| SEQ ID NO: 971 | ICIPCFTTDHQIARRCDDCCGGRGRGRCYGPQCLCR |
| SEQ ID NO: 972 | KCIPCFTTDHQIARRCDDCCGGRGRGRCYGPQCLCR |
| SEQ ID NO: 973 | ICIPCFTTDHQIAR(Cit)CDDCCGG(Cit)GRGKCYGPQCLCR |
| SEQ ID NO: 974 | ICIPCFTTDHQIAR(Cit)CDDCCGG(Cit)GRG(Cit)CYGPQCLCR |
| SEQ ID NO: 975 | KCIPCFTTDHQIAR(Cit)CDDCCGG(Cit)GRG(Cit)CYGPQCLCR |
| SEQ ID NO: 976 | TCTPCFTTDHQTARKCDDCCGGKGRGKCYGPQCLCR |
| SEQ ID NO: 977 | TCTPCFTTDHQTARACDDCCGGKGRGKCYGPQCLCR |
| SEQ ID NO: 978 | TCTPCFTTDHQTARRCDDCCGGKGRGKCYGPQCLCR |
| SEQ ID NO: 979 | TCTPCFTTDHQTARKCDDCCGGAGRGKCYGPQCLCR |
| SEQ ID NO: 980 | TCTPCFTTDHQTARACDDCCGGAGRGKCYGPQCLCR |
| SEQ ID NO: 981 | TCTPCFTTDHQTARRCDDCCGGAGRGKCYGPQCLCR |
| SEQ ID NO: 982 | TCTPCFTTDHQTARKCDDCCGGRGRGKCYGPQCLCR |
| SEQ ID NO: 983 | TCTPCFTTDHQTARACDDCCGGRGRGKCYGPQCLCR |

TABLE 1-continued

Peptide Sequences

| SEQ ID NO | Sequence |
| --- | --- |
| SEQ ID NO: 984 | TCTPCFTTDHQTARRCDDCCGGRGRGKCYGPQCLCR |
| SEQ ID NO: 985 | TCTPCFTTDHQTARKCDDCCGGKGRGACYGPQCLCR |
| SEQ ID NO: 986 | TCTPCFTTDHQTARACDDCCGGKGRGACYGPQCLCR |
| SEQ ID NO: 987 | TCTPCFTTDHQTARRCDDCCGGKGRGACYGPQCLCR |
| SEQ ID NO: 988 | TCTPCFTTDHQTARKCDDCCGGAGRGACYGPQCLCR |
| SEQ ID NO: 989 | TCTPCFTTDHQTARACDDCCGGAGRGACYGPQCLCR |
| SEQ ID NO: 990 | TCTPCFTTDHQTARRCDDCCGGAGRGACYGPQCLCR |
| SEQ ID NO: 991 | TCTPCFTTDHQTARKCDDCCGGRGRGACYGPQCLCR |
| SEQ ID NO: 992 | TCTPCFTTDHQTARACDDCCGGRGRGACYGPQCLCR |
| SEQ ID NO: 993 | TCTPCFTTDHQTARRCDDCCGGRGRGACYGPQCLCR |
| SEQ ID NO: 994 | TCTPCFTTDHQTARKCDDCCGGKGRGRCYGPQCLCR |
| SEQ ID NO: 995 | TCTPCFTTDHQTARACDDCCGGKGRGRCYGPQCLCR |
| SEQ ID NO: 996 | TCTPCFTTDHQTARRCDDCCGGKGRGRCYGPQCLCR |
| SEQ ID NO: 997 | TCTPCFTTDHQTARKCDDCCGGAGRGRCYGPQCLCR |
| SEQ ID NO: 998 | TCTPCFTTDHQTARACDDCCGGAGRGRCYGPQCLCR |
| SEQ ID NO: 999 | TCTPCFTTDHQTARRCDDCCGGAGRGRCYGPQCLCR |
| SEQ ID NO: 1000 | TCTPCFTTDHQTARKCDDCCGGRGRGRCYGPQCLCR |
| SEQ ID NO: 1001 | TCTPCFTTDHQTARACDDCCGGRGRGRCYGPQCLCR |
| SEQ ID NO: 1002 | TCTPCFTTDHQTARRCDDCCGGRGRGRCYGPQCLCR |
| SEQ ID NO: 1003 | KCTPCFTTDHQTARRCDDCCGGRGRGRCYGPQCLCR |
| SEQ ID NO: 1004 | TCTPCFTTDHQTAR(Cit)CDDCCGG(Cit)GRGKCYGPQCLCR |
| SEQ ID NO: 1005 | TCTPCFTTDHQTAR(Cit)CDDCCGG(Cit)GRG(Cit)CYGPQCLCR |
| SEQ ID NO: 1006 | KCTPCFTTDHQTAR(Cit)CDDCCGG(Cit)GRG(Cit)CYGPQCLCR |
| SEQ ID NO: 1007 | VCVPCFTTDHQVARKCDDCCGGKGRGKCYGPQCLCR |
| SEQ ID NO: 1008 | VCVPCFTTDHQVARACDDCCGGKGRGKCYGPQCLCR |
| SEQ ID NO: 1009 | VCVPCFTTDHQVARRCDDCCGGKGRGKCYGPQCLCR |
| SEQ ID NO: 1010 | VCVPCFTTDHQVARKCDDCCGGAGRGKCYGPQCLCR |
| SEQ ID NO: 1011 | VCVPCFTTDHQVARACDDCCGGAGRGKCYGPQCLCR |
| SEQ ID NO: 1012 | VCVPCFTTDHQVARRCDDCCGGAGRGKCYGPQCLCR |
| SEQ ID NO: 1013 | VCVPCFTTDHQVARKCDDCCGGRGRGKCYGPQCLCR |
| SEQ ID NO: 1014 | VCVPCFTTDHQVARACDDCCGGRGRGKCYGPQCLCR |
| SEQ ID NO: 1015 | VCVPCFTTDHQVARRCDDCCGGRGRGKCYGPQCLCR |
| SEQ ID NO: 1016 | VCVPCFTTDHQVARKCDDCCGGKGRGACYGPQCLCR |
| SEQ ID NO: 1017 | VCVPCFTTDHQVARACDDCCGGKGRGACYGPQCLCR |
| SEQ ID NO: 1018 | VCVPCFTTDHQVARRCDDCCGGKGRGACYGPQCLCR |
| SEQ ID NO: 1019 | VCVPCFTTDHQVARKCDDCCGGAGRGACYGPQCLCR |
| SEQ ID NO: 1020 | VCVPCFTTDHQVARACDDCCGGAGRGACYGPQCLCR |
| SEQ ID NO: 1021 | VCVPCFTTDHQVARRCDDCCGGAGRGACYGPQCLCR |

TABLE 1-continued

Peptide Sequences

| SEQ ID NO | Sequence |
|---|---|
| SEQ ID NO: 1022 | VCVPCFTTDHQVARKCDDCCGGRGRGACYGPQCLCR |
| SEQ ID NO: 1023 | VCVPCFTTDHQVARACDDCCGGRGRGACYGPQCLCR |
| SEQ ID NO: 1024 | VCVPCFTTDHQVARRCDDCCGGRGRGACYGPQCLCR |
| SEQ ID NO: 1025 | VCVPCFTTDHQVARKCDDCCGGKGRGRCYGPQCLCR |
| SEQ ID NO: 1026 | VCVPCFTTDHQVARACDDCCGGKGRGRCYGPQCLCR |
| SEQ ID NO: 1027 | VCVPCFTTDHQVARRCDDCCGGKGRGRCYGPQCLCR |
| SEQ ID NO: 1028 | VCVPCFTTDHQVARKCDDCCGGAGRGRCYGPQCLCR |
| SEQ ID NO: 1029 | VCVPCFTTDHQVARACDDCCGGAGRGRCYGPQCLCR |
| SEQ ID NO: 1030 | VCVPCFTTDHQVARRCDDCCGGAGRGRCYGPQCLCR |
| SEQ ID NO: 1031 | VCVPCFTTDHQVARKCDDCCGGRGRGRCYGPQCLCR |
| SEQ ID NO: 1032 | VCVPCFTTDHQVARACDDCCGGRGRGRCYGPQCLCR |
| SEQ ID NO: 1033 | VCVPCFTTDHQVARRCDDCCGGRGRGRCYGPQCLCR |
| SEQ ID NO: 1034 | KCVPCFTTDHQVARRCDDCCGGRGRGRCYGPQCLCR |
| SEQ ID NO: 1035 | VCVPCFTTDHQVAR(Cit)CDDCCGG(Cit)GRGKCYGPQCLCR |
| SEQ ID NO: 1036 | VCVPCFTTDHQVAR(Cit)CDDCCGG(Cit)GRG(Cit)CYGPQCLCR |
| SEQ ID NO: 1037 | KCVPCFTTDHQVAR(Cit)CDDCCGG(Cit)GRG(Cit)CYGPQCLCR |
| SEQ ID NO: 1038 | LCLPCFTTDHQLARKCDDCCGGKGRGKCYGPQCLCR |
| SEQ ID NO: 1039 | LCLPCFTTDHQLARACDDCCGGKGRGKCYGPQCLCR |
| SEQ ID NO: 1040 | LCLPCFTTDHQLARRCDDCCGGKGRGKCYGPQCLCR |
| SEQ ID NO: 1041 | LCLPCFTTDHQLARKCDDCCGGAGRGKCYGPQCLCR |
| SEQ ID NO: 1042 | LCLPCFTTDHQLARACDDCCGGAGRGKCYGPQCLCR |
| SEQ ID NO: 1043 | LCLPCFTTDHQLARRCDDCCGGAGRGKCYGPQCLCR |
| SEQ ID NO: 1044 | LCLPCFTTDHQLARKCDDCCGGRGRGKCYGPQCLCR |
| SEQ ID NO: 1045 | LCLPCFTTDHQLARACDDCCGGRGRGKCYGPQCLCR |
| SEQ ID NO: 1046 | LCLPCFTTDHQLARRCDDCCGGRGRGKCYGPQCLCR |
| SEQ ID NO: 1047 | LCLPCFTTDHQLARKCDDCCGGKGRGACYGPQCLCR |
| SEQ ID NO: 1048 | LCLPCFTTDHQLARACDDCCGGKGRGACYGPQCLCR |
| SEQ ID NO: 1049 | LCLPCFTTDHQLARRCDDCCGGKGRGACYGPQCLCR |
| SEQ ID NO: 1050 | LCLPCFTTDHQLARKCDDCCGGAGRGACYGPQCLCR |
| SEQ ID NO: 1051 | LCLPCFTTDHQLARACDDCCGGAGRGACYGPQCLCR |
| SEQ ID NO: 1052 | LCLPCFTTDHQLARRCDDCCGGAGRGACYGPQCLCR |
| SEQ ID NO: 1053 | LCLPCFTTDHQLARKCDDCCGGRGRGACYGPQCLCR |
| SEQ ID NO: 1054 | LCLPCFTTDHQLARACDDCCGGRGRGACYGPQCLCR |
| SEQ ID NO: 1055 | LCLPCFTTDHQLARRCDDCCGGRGRGACYGPQCLCR |
| SEQ ID NO: 1056 | LCLPCFTTDHQLARKCDDCCGGKGRGRCYGPQCLCR |
| SEQ ID NO: 1057 | LCLPCFTTDHQLARACDDCCGGKGRGRCYGPQCLCR |
| SEQ ID NO: 1058 | LCLPCFTTDHQLARRCDDCCGGKGRGRCYGPQCLCR |
| SEQ ID NO: 1059 | LCLPCFTTDHQLARKCDDCCGGAGRGRCYGPQCLCR |

TABLE 1-continued

Peptide Sequences

| SEQ ID NO | Sequence |
|---|---|
| SEQ ID NO: 1060 | LCLPCFTTDHQLARACDDCCGGAGRGRCYGPQCLCR |
| SEQ ID NO: 1061 | LCLPCFTTDHQLARRCDDCCGGAGRGRCYGPQCLCR |
| SEQ ID NO: 1062 | LCLPCFTTDHQLARKCDDCCGGRGRGRCYGPQCLCR |
| SEQ ID NO: 1063 | LCLPCFTTDHQLARACDDCCGGRGRGRCYGPQCLCR |
| SEQ ID NO: 1064 | LCLPCFTTDHQLARRCDDCCGGRGRGRCYGPQCLCR |
| SEQ ID NO: 1065 | KCLPCFTTDHQLARRCDDCCGGRGRGRCYGPQCLCR |
| SEQ ID NO: 1066 | LCLPCFTTDHQLAR(Cit)CDDCCGG(Cit)GRGKCYGPQCLCR |
| SEQ ID NO: 1067 | LCLPCFTTDHQLAR(Cit)CDDCCGG(Cit)GRG(Cit)CYGPQCLCR |
| SEQ ID NO: 1068 | KCLPCFTTDHQLAR(Cit)CDDCCGG(Cit)GRG(Cit)CYGPQCLCR |
| SEQ ID NO: 1069 | SCSPCFTTDHQSARKCDDCCGGKGRGKCYGPQCLCR |
| SEQ ID NO: 1070 | SCSPCFTTDHQSARACDDCCGGKGRGKCYGPQCLCR |
| SEQ ID NO: 1071 | SCSPCFTTDHQSARRCDDCCGGKGRGKCYGPQCLCR |
| SEQ ID NO: 1072 | SCSPCFTTDHQSARKCDDCCGGAGRGKCYGPQCLCR |
| SEQ ID NO: 1073 | SCSPCFTTDHQSARACDDCCGGAGRGKCYGPQCLCR |
| SEQ ID NO: 1074 | SCSPCFTTDHQSARRCDDCCGGAGRGKCYGPQCLCR |
| SEQ ID NO: 1075 | SCSPCFTTDHQSARKCDDCCGGRGRGKCYGPQCLCR |
| SEQ ID NO: 1076 | SCSPCFTTDHQSARACDDCCGGRGRGKCYGPQCLCR |
| SEQ ID NO: 1077 | SCSPCFTTDHQSARRCDDCCGGRGRGKCYGPQCLCR |
| SEQ ID NO: 1078 | SCSPCFTTDHQSARKCDDCCGGKGRGACYGPQCLCR |
| SEQ ID NO: 1079 | SCSPCFTTDHQSARACDDCCGGKGRGACYGPQCLCR |
| SEQ ID NO: 1080 | SCSPCFTTDHQSARRCDDCCGGKGRGACYGPQCLCR |
| SEQ ID NO: 1081 | SCSPCFTTDHQSARKCDDCCGGAGRGACYGPQCLCR |
| SEQ ID NO: 1082 | SCSPCFTTDHQSARACDDCCGGAGRGACYGPQCLCR |
| SEQ ID NO: 1083 | SCSPCFTTDHQSARRCDDCCGGAGRGACYGPQCLCR |
| SEQ ID NO: 1084 | SCSPCFTTDHQSARKCDDCCGGRGRGACYGPQCLCR |
| SEQ ID NO: 1085 | SCSPCFTTDHQSARACDDCCGGRGRGACYGPQCLCR |
| SEQ ID NO: 1086 | SCSPCFTTDHQSARRCDDCCGGRGRGACYGPQCLCR |
| SEQ ID NO: 1087 | SCSPCFTTDHQSARKCDDCCGGKGRGRCYGPQCLCR |
| SEQ ID NO: 1088 | SCSPCFTTDHQSARACDDCCGGKGRGRCYGPQCLCR |
| SEQ ID NO: 1089 | SCSPCFTTDHQSARRCDDCCGGKGRGRCYGPQCLCR |
| SEQ ID NO: 1090 | SCSPCFTTDHQSARKCDDCCGGAGRGRCYGPQCLCR |
| SEQ ID NO: 1091 | SCSPCFTTDHQSARACDDCCGGAGRGRCYGPQCLCR |
| SEQ ID NO: 1092 | SCSPCFTTDHQSARRCDDCCGGAGRGRCYGPQCLCR |
| SEQ ID NO: 1093 | SCSPCFTTDHQSARKCDDCCGGRGRGRCYGPQCLCR |
| SEQ ID NO: 1094 | SCSPCFTTDHQSARACDDCCGGRGRGRCYGPQCLCR |
| SEQ ID NO: 1095 | SCSPCFTTDHQSARRCDDCCGGRGRGRCYGPQCLCR |
| SEQ ID NO: 1096 | KCSPCFTTDHQSARRCDDCCGGRGRGRCYGPQCLCR |
| SEQ ID NO: 1097 | SCSPCFTTDHQSAR(Cit)CDDCCGG(Cit)GRGKCYGPQCLCR |

TABLE 1-continued

Peptide Sequences

| SEQ ID NO | Sequence |
|---|---|
| SEQ ID NO: 1098 | SCSPCFTTDHQSAR(Cit)CDDCCGG(Cit)GRG(Cit)CYGPQCLCR |
| SEQ ID NO: 1099 | KCSPCFTTDHQSAR(Cit)CDDCCGG(Cit)GRG(Cit)CYGPQCLCR |
| SEQ ID NO: 1100 | MCMPCFTTDPNMARKCRDCCGGNGKCFGPQCLCNRG |
| SEQ ID NO: 1101 | MCMPCFTTDHNMAKKCRDCCGGNGKCFGYQCLCNRG |
| SEQ ID NO: 1102 | MCMPCFTTDHQTARRCRDCCGGRGRKCFGQCLCGYD |
| SEQ ID NO: 1103 | ACGPCFTTDPQMAEKCSDCCGGIGTCYGPQCLCNRL |
| SEQ ID NO: 1104 | MCMPCFTTRPNMAQQCRDCCRGRGKCFGPQCLCG |
| SEQ ID NO: 1105 | MCMPCFTTRPNMAQQCRDCCRGRGKCFGPQCLCGYD |
| SEQ ID NO: 1106 | MCMPCFTTNLNMEQECRDCCGGTGRCFGPQCLCG |
| SEQ ID NO: 1107 | GCNIPCFTTDRYMARKCKECCRGYGNCFGPQCLCNRG |
| SEQ ID NO: 1108 | GCGPCFTTDANMARKCRECCGGNGKCFGPQCLCNRE |
| SEQ ID NO: 1109 | GCGPCFTTDANMARKCRECCGGIGKCFGPQCLCNRI |
| SEQ ID NO: 1110 | MCMPCFTTRPDMAQQCRACCKGRGKCFGPQCLCG |
| SEQ ID NO: 1111 | MCIPCFTTNPNMAAKCNACCGSRRGSCRGPQCIC |
| SEQ ID NO: 1112 | MCMPCFTTRPDMAQQCRDCCGGNGKCFGYQCLCNR |
| SEQ ID NO: 1113 | CGPCFTTDPYTESKCATCCGGRGKCVGPQCLCNR |
| SEQ ID NO: 1114 | RCGPCFTTDPQTQAKCSECCGRKGGVCKGPQCICG |
| SEQ ID NO: 1115 | CGPCFTKDPETEKKCATCCGGIGRCFGPQCLCNRG |
| SEQ ID NO: 1116 | MCMPCFTTDHQMARRCDDCCGGRGRKCWGPQCLCR |
| SEQ ID NO: 1117 | AMCMPCFTTDHNMAKKCRDCCGGNGKCFGPQCLCNRG |
| SEQ ID NO: 1118 | CGPCFTTDWESEKKCAECCGGIGRCFGPQCLCNRK |
| SEQ ID NO: 1119 | CGPCFTTDHQTEQKCAECCGGIGKCYGPQCLCRG |
| SEQ ID NO: 1120 | CGPCFTTDRQMEQKCAECCGGIGKCYGPQCLCRG |
| SEQ ID NO: 1121 | CGPCFTTDHQTEQKCAECCGGIGKCYGPQCLC |
| SEQ ID NO: 1122 | CNIPCFTTDHQMARKCDDCCGGRGKCYGPQCLCRG |
| SEQ ID NO: 1123 | RCGPCFTTDPQTQAKCSECCGRKGGVCKGPQCICGIQ |
| SEQ ID NO: 1124 | RCPPCFTTNPNMEADCRKCCGGRGYCASYQCICPG |
| SEQ ID NO: 1125 | CGPCFTTDHNMARKCDECCGGKGRGKCFGPQCLCR |
| SEQ ID NO: 1126 | VCNIPCFTTDQQMARKCSDCCGGKGRGKCYGPQCLCR |
| SEQ ID NO: 1127 | MCGPCFTTDANMARKCRECCGGIGKCFGPQCLCNRI |
| SEQ ID NO: 1128 | MCGPCFTTDANMAAACRECCGGIGKCFGPQCLCNRI |
| SEQ ID NO: 1129 | MCGPCFTTDANMARKCAECCGGIGKCFGPQCLCNRI |
| SEQ ID NO: 1130 | MCGPCFTTDANMARKCRECCGGIGACFGPQCLCNRI |
| SEQ ID NO: 1131 | MCGPCFTTDANMARKCRECCGGIGKCFGPQCLCNAI |
| SEQ ID NO: 1132 | CNIPCFTTRPNMAQQCRDCCRGRGKCFGPQCLCGYD |
| SEQ ID NO: 1133 | MCMPCFTTNLNMEQECRDCCGGTGRCFGPQCLCGYD |
| SEQ ID NO: 1134 | CNIPCFTTRPNMAQQCRDCCRGRGKCFGPQCLCGYD |
| SEQ ID NO: 1253 | EISCEPGKTFKDKCNTCRCGADGKSAACTLKACPNQ |

TABLE 1-continued

Peptide Sequences

| SEQ ID NO | Sequence |
|---|---|
| SEQ ID NO: 1254 | SCEPGRTFRDRCNTCRCGADGRSAACTLRACPNQ |
| SEQ ID NO: 1255 | SCEPGRTFRDRCNTCKCGADGRSAACTLRACPNQ |
| SEQ ID NO: 1256 | SCEPGTTFRDRCNTCRCGSDGRSAACTLRACPQ |
| SEQ ID NO: 1257 | SCTPGTTFRDRCNTCRCSSNGRSAACTLRACPPGSY |
| SEQ ID NO: 1258 | SCTPGTTFRNRCNTCRCGSNGRSASCTLMACPPGSY |
| SEQ ID NO: 1259 | SCTPGATFRNRCNTCRCGSNGRSASCTLMACPPGSY |
| SEQ ID NO: 1260 | SCQPGTTYQRGCNTCRCLEDGQTEACTLRLC |
| SEQ ID NO: 1261 | SCTPGATYREGCNICRCRSDGRSGACTRRICPVDSN |
| SEQ ID NO: 1262 | SCQPGTTFRRDCNTCVCNRDGTNAACTLRACL |
| SEQ ID NO: 1263 | GSMCNIPCFTTDHQMARKCDDCCGGKGRGKCYGPQCLCR |
| SEQ ID NO: 1264 | GSACMPCFTTDHQMARKCDDCCGGKGRGKCYGPQCLCR |
| SEQ ID NO: 1265 | GSMCAPCFTTDHQMARKCDDCCGGKGRGKCYGPQCLCR |
| SEQ ID NO: 1266 | GSMCMACFTTDHQMARKCDDCCGGKGRGKCYGPQCLCR |
| SEQ ID NO: 1267 | GSMCNIPCATTDHQMARKCDDCCGGKGRGKCYGPQCLCR |
| SEQ ID NO: 1268 | GSMCNIPCFATDHQMARKCDDCCGGKGRGKCYGPQCLCR |
| SEQ ID NO: 1269 | GSMCNIPCFTADHQMARKCDDCCGGKGRGKCYGPQCLCR |
| SEQ ID NO: 1270 | GSMCNIPCFTTAHQMARKCDDCCGGKGRGKCYGPQCLCR |
| SEQ ID NO: 1271 | GSMCNIPCFTTDAQMARKCDDCCGGKGRGKCYGPQCLCR |
| SEQ ID NO: 1272 | GSMCNIPCFTTDHAMARKCDDCCGGKGRGKCYGPQCLCR |
| SEQ ID NO: 1273 | GSMCNIPCFTTDHQAARKCDDCCGGKGRGKCYGPQCLCR |
| SEQ ID NO: 1274 | GSMCNIPCFTTDHQMAAKCDDCCGGKGRGKCYGPQCLCR |
| SEQ ID NO: 1275 | GSMCNIPCFTTDHQMARACDDCCGGKGRGKCYGPQCLCR |
| SEQ ID NO: 1276 | GSMCNIPCFTTDHQMARKCADCCGGKGRGKCYGPQCLCR |
| SEQ ID NO: 1277 | GSMCNIPCFTTDHQMARKCDACCGGKGRGKCYGPQCLCR |
| SEQ ID NO: 1278 | GSMCNIPCFTTDHQMARKCDDCCAGKGRGKCYGPQCLCR |
| SEQ ID NO: 1279 | GSMCNIPCFTTDHQMARKCDDCCGAKGRGKCYGPQCLCR |
| SEQ ID NO: 1280 | GSMCNIPCFTTDHQMARKCDDCCGGAGRGKCYGPQCLCR |
| SEQ ID NO: 1281 | GSMCNIPCFTTDHQMARKCDDCCGGKARGKCYGPQCLCR |
| SEQ ID NO: 1282 | GSMCNIPCFTTDHQMARKCDDCCGGKGAGKCYGPQCLCR |
| SEQ ID NO: 1283 | GSMCNIPCFTTDHQMARKCDDCCGGKGRGACYGPQCLCR |
| SEQ ID NO: 1284 | GSMCNIPCFTTDHQMARKCDDCCGGKGRGKCAGPQCLCR |
| SEQ ID NO: 1285 | GSMCNIPCFTTDHQMARKCDDCCGGKGRGKCYAPQCLCR |
| SEQ ID NO: 1286 | GSMCNIPCFTTDHQMARKCDDCCGGKGRGKCYGAQCLCR |
| SEQ ID NO: 1287 | GSMCNIPCFTTDHQMARKCDDCCGGKGRGKCYGPACLCR |
| SEQ ID NO: 1288 | GSMCNIPCFTTDHQMARKCDDCCGGKGRGKCYGPQCACR |
| SEQ ID NO: 1289 | GSMCNIPCFTTDHQMARKCDDCCGGKGRGKCYGPQCLCA |
| SEQ ID NO: 1290 | MCNIPCFTTDHQMARKCDDCCGGKGRGKCYGPQCLCR |
| SEQ ID NO: 1291 | ACMPCFTTDHQMARKCDDCCGGKGRGKCYGPQCLCR |

TABLE 1-continued

Peptide Sequences

| SEQ ID NO | Sequence |
|---|---|
| SEQ ID NO: 1292 | MCAPCFTTDHQMARKCDDCCGGKGRGKCYGPQCLCR |
| SEQ ID NO: 1293 | MCMACFTTDHQMARKCDDCCGGKGRGKCYGPQCLCR |
| SEQ ID NO: 1294 | MCMPCATTDHQMARKCDDCCGGKGRGKCYGPQCLCR |
| SEQ ID NO: 1295 | MCMPCFATDHQMARKCDDCCGGKGRGKCYGPQCLCR |
| SEQ ID NO: 1296 | MCMPCFTADHQMARKCDDCCGGKGRGKCYGPQCLCR |
| SEQ ID NO: 1297 | MCMPCFTTAHQMARKCDDCCGGKGRGKCYGPQCLCR |
| SEQ ID NO: 1298 | MCMPCFTTDAQMARKCDDCCGGKGRGKCYGPQCLCR |
| SEQ ID NO: 1299 | MCMPCFTTDHAMARKCDDCCGGKGRGKCYGPQCLCR |
| SEQ ID NO: 1300 | MCMPCFTTDHQAARKCDDCCGGKGRGKCYGPQCLCR |
| SEQ ID NO: 1301 | MCMPCFTTDHQMAAKCDDCCGGKGRGKCYGPQCLCR |
| SEQ ID NO: 1302 | MCMPCFTTDHQMARACDDCCGGKGRGKCYGPQCLCR |
| SEQ ID NO: 1303 | MCMPCFTTDHQMARKCADCCGGKGRGKCYGPQCLCR |
| SEQ ID NO: 1304 | MCMPCFTTDHQMARKCDACCGGKGRGKCYGPQCLCR |
| SEQ ID NO: 1305 | MCMPCFTTDHQMARKCDDCCAGKGRGKCYGPQCLCR |
| SEQ ID NO: 1306 | MCMPCFTTDHQMARKCDDCCGAKGRGKCYGPQCLCR |
| SEQ ID NO: 1307 | MCMPCFTTDHQMARKCDDCCGGAGRGKCYGPQCLCR |
| SEQ ID NO: 1308 | MCMPCFTTDHQMARKCDDCCGGKARGKCYGPQCLCR |
| SEQ ID NO: 1309 | MCMPCFTTDHQMARKCDDCCGGKGAGKCYGPQCLCR |
| SEQ ID NO: 1310 | MCMPCFTTDHQMARKCDDCCGGKGRGACYGPQCLCR |
| SEQ ID NO: 1311 | MCMPCFTTDHQMARKCDDCCGGKGRGKCAGPQCLCR |
| SEQ ID NO: 1312 | MCMPCFTTDHQMARKCDDCCGGKGRGKCYAPQCLCR |
| SEQ ID NO: 1313 | MCMPCFTTDHQMARKCDDCCGGKGRGKCYGAQCLCR |
| SEQ ID NO: 1314 | MCMPCFTTDHQMARKCDDCCGGKGRGKCYGPACLCR |
| SEQ ID NO: 1315 | MCMPCFTTDHQMARKCDDCCGGKGRGKCYGPQCACR |
| SEQ ID NO: 1316 | MCMPCFTTDHQMARKCDDCCGGKGRGKCYGPQCLCA |

In some embodiments, a peptide of the present disclosure in a peptide-I/O complex disclosed herein can be a peptide comprising at least 70%, at least 75%, at least 80%, at least 82%, at least 84%, at least 86%, at least 88%, at least 90%, at least 91%, at least 92%, at least 93%, at least 94%, at least 95%, at least 96%, at least 97%, at least 98%, at least 99%, or at least 100% sequence identity to SEQ ID NO: 1, or a variant, homolog, or fragment thereof. In some embodiments, a peptide of the present disclosure in a peptide-I/O complex disclosed herein can be a peptide comprising at least 70%, at least 75%, at least 80%, at least 82%, at least 84%, at least 86%, at least 88%, at least 90%, at least 91%, at least 92%, at least 93%, at least 94%, at least 95%, at least 96%, at least 97%, at least 98%, at least 99%, or at least 100% sequence identity to SEQ ID NO: 2, or a variant, homolog, or fragment thereof. In some embodiments, a peptide of the present disclosure in a peptide-I/O complex disclosed herein can be a peptide comprising at least 70%, at least 75%, at least 80%, at least 82%, at least 84%, at least 86%, at least 88%, at least 90%, at least 91%, at least 92%, at least 93%, at least 94%, at least 95%, at least 96%, at least 97%, at least 98%, at least 99%, or at least 100% sequence identity to SEQ ID NO: 568, or a variant, homolog, or fragment thereof. In some embodiments, a peptide of the present disclosure in a peptide-I/O complex disclosed herein can be a peptide comprising at least 70%, at least 75%, at least 80%, at least 82%, at least 84%, at least 86%, at least 88%, at least 90%, at least 91%, at least 92%, at least 93%, at least 94%, at least 95%, at least 96%, at least 97%, at least 98%, at least 99%, or at least 100% sequence identity to SEQ ID NO: 569, or a variant, homolog, or fragment thereof. In some embodiments, a peptide of the present disclosure in a peptide-I/O complex disclosed herein can be a peptide comprising at least 70%, at least 75%, at least 80%, at least 82%, at least 84%, at least 86%, at least 88%, at least 90%, at least 91%, at least 92%, at least 93%, at least 94%, at least 95%, at least 96%, at least 97%, at least 98%, at least 99%, or at least 100% sequence identity to SEQ ID NO: 570, or a variant, homolog, or fragment thereof.

In some embodiments, a chlorotoxin (CTX) peptide and some of its variants can bind to many different types of human tumors (Dardevet et al., Toxins (Basel) 7:1079-1101 (2015); Ojeda et al., Biopolymers 106:25-36 (2016); Stroud et al., Current Pharmaceutical Design 17:4362-4371 (2011)). Chlorotoxin which has optionally been fluorescently labeled or radiolabeled, can exhibit tumor-selective uptake in mouse models of brain cancer, prostate cancer, sarcoma, and colon cancer Veiseh et al., Cancer Res 67:6882-6888 (2007); Kovar et al., Anal Biochem 440:212-219 (2013). Tozuleristide, a fluorescently labeled variant of CTX, exhibits tumor-selective uptake in multiple tumor types in rodent models (Butte et al., Neurosurgical Focus 36:E1 (2014); Baik et al., JAMA Otolaryngol Head Neck Surg 142:330-338 (2016)), and in dogs with spontaneous tumors (Fidel et al., Cancer Res 75:4283-4291 (2015)). A radiolabeled chlorotoxin was tested in Phase 1 and 2 clinical trials. The radiolabeled chlorotoxin can selectively bind to solid tumors, including colon cancer, prostate cancer, non-small cell lung cancer, metastatic melanoma, pancreatic cancer, and glioma (Hockaday et al., J Nucl Med 46:580-586 (2005); Mamelak et al., J Clin Oncol 24:3644-3650 (2006); Gribbin et al., J Clin Oncol 27:abstr e14507 (2009); O'Neill and Jacoby, US Patent Application 20100215575 (2010)). In some embodiments, a peptide of this disclosure exhibits a high tumor-to-background signal after administration to a subject, wherein the subject is a human or a non-human animal. Minimal binding to normal tissue as compared to tumor tissue, has shown the ability of chlorotoxin peptide and some of its variants to be capable of tumor homing. In some embodiments, any peptide of this disclosure can bind to solid tumors including, but not limited to, colon cancer, prostate cancer, non-small cell lung cancer, melanoma, breast cancer, and glioma with minimal off-target binding to normal tissue.

Chlorotoxin variants with either alanine or arginine substitutions at positions 15 and 23 (K15A K23A, or K15R K23R) retain their tumor binding properties, and a cyclized version retains tumor binding properties and has a longer serum half-life compared with the linear peptides (Akcan et al, J Med Chem 54:782-787 (2011)). Ala scans (replacing one or more residues with Ala throughout the peptide sequence) can identify important regions of the peptide for function, such as by creating the variant peptides and testing them for function such as tumor accumulation, blood brain barrier penetration, correct folding, and I/O pathway engagement. One or more amino acid residues within peptides of this disclosure, such as SEQ ID NO: 568, can be replaced with Ala. The observed long retention time of both radiolabeled (Hockaday et al., J Nucl Med 46:580-586 (2005)) and fluorescence tagged (Veiseh et al., Cancer Res 67:6882-6888 (2007)) chlorotoxin suggests a mechanism other than simple cell-surface binding kinetics. Chlorotoxin peptides and some of its variants have been shown to be internalized by cancer cells (Ojeda et al., Biopolymers 108 (2017)) by an active process that is enhanced by lysine to arginine substitutions at positions 15 and 23 (Ojeda et al., Biopolymers 108 (2017); Wiranowska et al., Cancer Cell Intl 11:1-13 (2011)). Chlorotoxin can associate with cell-surface Annexin A2 (ANXA2) (Kesavan et al., J Biol Chem 285:4366-4374 (2010)), which with S100A10 forms a 94 kDa heterotetramer called Calpactin I or AIIt (MacLeod et al., J Biol Chem 278:25577-25584 (2003)). Annexin A2 is known to be capable of associating with lipid rafts, and can be internalized and targeted for recycling rather than degradation (Valapala and Vishwanatha, J Biol Chem 286:30911-30925 (2011)). Chlorotoxin can also interact with and reduce cell surface expression of MMP-2 (Deshane et al., J Biol Chem 278:4135-4144 (2003)). Internalization of labeled chlorotoxin can be verified by the punctate signal inside cultured cells following exposure to chlorotoxin: Cy5.5 (Veiseh et al., Cancer Res 67:6882-6888 (2007)). Further work showed that chlorotoxin can be internalized in cancer cells via clathrin-mediated endocytosis, and that it can further localize to the perinuclear Golgi region (Wiranowska et al., Cancer Cell International 11:27 (2011)). Chlorotoxin can be conjugated to cytotoxic drugs, such as onconase, and can improve the anti-tumor effect of the cytotoxic drug by increasing cellular uptake (Wang and Guo, Oncol Lett 9:1337-1342 (2015)). In some embodiments, any peptide of the present disclosure can be internalized by binding to cell surface targets, by an active process that is enhanced upon lysine to arginine mutations at any residue in the peptide, by pinocytosis, can associate with Annexin A2, can associate with calpactin, can associate with lipid rafts, can interact with MMP-2 via caveolin-mediated internalization, or can be internalized via clathrin-mediated endocytosis.

In vivo studies also demonstrate the ability of pacifastin peptides, also known as LCMI-II peptides, THP1 peptides, and chymotrypsin inhibitors, to accumulate in and penetrate the cells of tumors (Sottero et al., Anticancer Research 38:51-60 (2018)), such as the peptides of SEQ ID No: 1243-SEQ ID NO: 1262. These peptides, such as those set forth in SEQ ID NO: 1243-SEQ ID NO: 1262, can interact with proteases, such as the serine proteases chymotrypsin and elastase. It is possible that proteases are upregulated and present at higher levels in the tumor microenvironment, such as cancer-associated serine proteases such as type II transmembrane serine proteases matriptase, hepsin, TMPRSS2, and TMPRSS4, and binding or interacting with them causes the preferential accumulation of pacifastin peptides in tumor and tumor cells. These peptides, such as those set forth in SEQ ID NO: 1243-SEQ ID NO: 1262, can be highly tolerant to mutations. By complexing an I/O agent with a pacifastin peptide, or variant thereof, such as those set forth in SEQ ID NO: 1243-SEQ ID NO: 1262, the I/O agent can be delivered preferentially to tumors, accumulate in tumors, or be delivered into subcellular compartments or the cytoplasm of tumor cells or the tumor microenvironment. Moreover, I/O delivery can be achieved using the peptide-I/O complexes of the present invention to cancers and tumors where cancer-associated proteases, such as serine proteases, chymotrypsin and elastase serine proteases, type II transmembrane serine proteases, matriptase, hepsin, TMPRSS2, TMPRSS4, and the like, are upregulated or present.

Any one of the peptides disclosed herein, for example any of SEQ ID NO: 1-SEQ ID NO: 1134, SEQ ID NO: 1243-SEQ ID NO: 1262, or SEQ ID NO: 1263-SEQ ID NO: 1316, can have cell penetrating properties, BBB crossing properties, tumor homing properties, or a combination thereof. In any of SEQ ID NO: 1-SEQ ID NO: 1134, SEQ ID NO: 1243-SEQ ID NO: 1262, or SEQ ID NO: 1263-SEQ ID NO: 1316 or fragment thereof, any one or more K residues can be replaced by an R residue or any one or more R residues can be replaced by a K residue. In any of SEQ ID NO: 1-SEQ ID NO: 1134, SEQ ID NO: 1243-SEQ ID NO: 1262, or SEQ ID NO: 1263-SEQ ID NO: 1316 or any fragment thereof, any one or more M residues can be replaced by any one of I, L, or V residues, any one or more L residues can be replaced by any one of V, I, or M residues, any one or more I residues can be replaced by any one of M, L, or V residues, or any one or more V residues can be replaced by any one of I, L, or M residues. In any embodiment, at least one of the amino acids alone or in combination can be interchanged in the peptides or peptide fragments as follows: K/R, M/I/L/V, G/A, S/T, Q/N, and D/E wherein each letter is each individually any amino acid or amino acid analogue. In some instances, the peptide can contain only one lysine residue, or no lysine residue. In any of SEQ ID NO: 1-SEQ ID NO: 1134, SEQ ID NO: 1243-SEQ ID NO: 1262, or SEQ ID NO: 1263-SEQ ID NO: 1316 or fragment thereof, any amino acid can be replaced with citrulline (Cit). In some cases, a peptide can include the first two N-terminal amino acids GS, as with peptides of SEQ ID NO: 1-SEQ ID NO: 567, SEQ ID NO: 1243-SEQ ID NO: 1252, or SEQ ID NO: 1263-SEQ ID NO: 1289, or such N-terminal amino acids (GS) can be substituted by any other one or two amino acids. In other cases, a peptide does not include the first two N-terminal amino acids GS, as with peptides of SEQ ID NO: 568-SEQ ID NO: 1134, SEQ ID NO: 1253-SEQ ID NO: 1262, or SEQ ID NO: 1290-SEQ ID NO: 1316. In some cases, the N-terminus of the peptide can be blocked, such as by an acetyl group; in other instances the C-terminus of the peptide can be blocked, such as by an amide group.

In some instances, the peptide is any one of SEQ ID NO: 1-SEQ ID NO: 1134, SEQ ID NO: 1243-SEQ ID NO: 1262, or SEQ ID NO: 1263-SEQ ID NO: 1316 or a functional fragment thereof, in which the functional fragment thereof can home, target, be directed to, migrate to, be retained by, accumulate in, or bind to specific regions, tissues, structures, or cells of tumors like the peptide of which it is a functional fragment. In other embodiments, a peptide of the disclosure further comprises a peptide with 99%, 98%, 97%, 96,%, 95%, 90%, 85%, or 80% homology to any one of SEQ ID NO: 1-SEQ ID NO: 1134, SEQ ID NO: 1243-SEQ ID NO: 1262, or SEQ ID NO: 1263-SEQ ID NO: 1316. In further embodiments, the functional fragment thereof can comprise a contiguous fragment of any one of SEQ ID NO: 1-SEQ ID NO: 1134, SEQ ID NO: 1243-SEQ ID NO: 1262, or SEQ ID NO: 1263-SEQ ID NO: 1316 that is at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46 residues long, wherein the functional fragment thereof can be selected from any portion of the peptide. In some embodiments, the functional fragment thereof can contact the cell to which it homes and can exhibit properties of those described herein for peptide and peptide-I/O complexes. In some embodiments, any peptide of the present disclosure can be additionally conjugated or fused to a cell pepentrating peptides (CPP) of TABLE 2, any CPPs disclosed herein, or any other moieties having CPP properties.

In some cases, an engineering of one or more mutations within a peptide can yield a peptide with an altered isoelectric point, charge, surface charge, or rheology at physiological pH. Such engineering of a mutation to a peptide derived from a scorpion or spider can change the net charge of the complex, for example, by decreasing the net charge by 1, 2, 3, 4, or 5, or by increasing the net charge by 1, 2, 3, 4, or 5. In such cases, the engineered mutation can facilitate the ability of the peptide to contact the tumor. Suitable amino acid modifications for improving the rheology and potency of a peptide can include conservative or non-conservative mutations. A peptide can comprise at most 1 amino acid mutation, at most 2 amino acid mutations, at most 3 amino acid mutations, at most 4 amino acid mutations, at most 5 amino acid mutations, at most 6 amino acid mutations, at most 7 amino acid mutations, at most 8 amino acid mutations, at most 9 amino acid mutations, at most 10 amino acid mutations, or another suitable number as compared to the sequence of the venom component peptide or toxin that the peptide is derived from. In other cases, a peptide, or a functional fragment thereof, can comprise at least 1 amino acid mutation, at least 2 amino acid mutations, at least 3 amino acid mutations, at least 4 amino acid mutations, at least 5 amino acid mutations, at least 6 amino acid mutations, at least 7 amino acid mutations, at least 8 amino acid mutations, at least 9 amino acid mutations, at least 10 amino acid mutations, or another suitable number as compared to the sequence of the venom component peptide or toxin that the peptide is derived from. In some embodiments, a mutation can be engineered within a peptide to provide a peptide that has a desired charge or stability at physiological pH.

The NMR solution structures, x-ray crystallography, or crystal structures of related structural homologs can be used to inform mutational strategies that can improve the folding, stability, and manufacturability of the peptide, while maintaining the ability of a peptide to home to tumor. They can be used to predict the 3D pharmacophore of a group of structurally homologous scaffolds, as well as to predict possible graft regions of related proteins to create chimeras with improved properties. For example, this strategy can be used to identify critical amino acid positions and loops that can be used to design drugs with improved properties or to correct deleterious mutations that complicate folding and manufacturability for the peptides. These key amino acid positions and loops can be retained while other residues in the peptide sequences can be mutated to improve, change, remove, or otherwise modify function, homing, and activity of the peptide.

Additionally, the comparison of the primary sequences and the tertiary sequences of two or more peptides can be used to reveal sequence and 3D folding patterns that can be leveraged to improve the peptides and parse out the biological activity of these peptides. For example, comparing two different peptide scaffolds (e.g., a peptide of any one of SEQ ID NO: 1-SEQ ID NO: 1134, SEQ ID NO: 1243-SEQ ID NO: 1262, or SEQ ID NO: 1263-SEQ ID NO: 1316) that home to tumor can lead to the identification of conserved pharmacophores that can guide engineering strategies, such as designing variants with improved folding properties. Important pharmacophore, for example, can comprise aromatic residues or basic residues, which can be important for binding. Any of the peptides of the present invention (e.g., a peptide of any one of SEQ ID NO: 1-SEQ ID NO: 1134, SEQ ID NO: 1243-SEQ ID NO: 1262, or SEQ ID NO: 1263-SEQ ID NO: 1316) can be used as a peptide scaffold.

Improved peptides can also be engineered based upon immunogenicity information, such as immunogenicity information predicted by TEPITOPE and TEPITOPEpan or other in silico immunogenicity prediction methods. TEPITOPE is a computational approach which uses position specific scoring matrix to provide prediction rules for whether a peptide will bind to 51 different HLA-DR alleles, and TEPITOPE-pan is method that uses TEPITOPE to extrapolate from HLA-DR molecules with known binding specificities to HLA-DR molecules with unknown binding specificities based on pocket similarity. For example, TEPITOPE and TEPITOPEpan can be used to determine immunogenicity of peptides that have cell penetrating properties, BBB crossing properties, homing to tumors properties, or a combination thereof. Comparison of peptides with high immunogenicity to peptides with low immunogenicity can guide engineering strategies for designing variants with decreased immunogenicity or for identifying within a group of peptides of similar cell penetrating, tumor homing activity, BBB crossing activity, or a combination thereof, which peptides induce the least immunogenicity.

The present disclosure can also encompass multimers of the various peptides described herein. Examples of multimers include dimers, trimers, tetramers, pentamers, hexamers, heptamers, and so on. A multimer can be a homomer formed from a plurality of identical subunits or a heteromer formed from a plurality of different subunits. In some embodiments, a peptide of the present disclosure is arranged in a multimeric structure with at least one other peptide, or two, three, four, five, six, seven, eight, nine, ten, or more other peptides. In certain embodiments, the peptides of a multimeric structure each can have the same sequence. In alternative embodiments, some or all of the peptides of a multimeric structure can have different sequences. In further embodiments, the multimeric structure can comprise a dimer, trimer, tetramer, pentamer, hexamer, or heptamer. A multimer can optionally be formed by creating a fusion of the peptide sequences with linkers in between each peptide within the multimer, for example with linkers comprising SEQ ID NO: 1163-SEQ ID NO: 1172, or by conjugating each peptide within the multimer to a substrate such as a polymer or a dendrimer, or any combination thereof.

The present disclosure can further include a peptide of any one of SEQ ID NO: 1-SEQ ID NO: 1134, SEQ ID NO: 1243-SEQ ID NO: 1262, or SEQ ID NO: 1263-SEQ ID NO: 1316 that can be used as a peptide scaffold that, e.g., can be used as a starting point for generating additional peptides. In some embodiments, a scaffold can be derived from a variety of cysteine-dense peptides such as knottins or hitchins. Some suitable peptides for a scaffold can include, but are not limited to, chlorotoxin, brazzein, circulin, stecrisp, hanatoxin, midkine, hefutoxin, potato carboxypeptidase inhibitor, bubble protein, attractin, α-GI, α-GID, μ-PIIIA, ω-MVIIA, ω-CVID, χ-MrIA, ρ-TIA, conantokin G, contulakin G, GsMTx4, margatoxin, shK, toxin K, chymotrypsin inhibitor (CTI), and EGF epiregulin core.

Moreover, any one of SEQ ID NO: 1-SEQ ID NO: 1134, SEQ ID NO: 1243-SEQ ID NO: 1262, or SEQ ID NO: 1263-SEQ ID NO: 1316 can likewise be used as a starting point or scaffold for generating additional peptides. In some embodiments, a peptide sequence of the disclosure is flanked by additional amino acids. One or more additional amino acids can, for example, confer a desired in vivo charge, isoelectric point, chemical conjugation site, stability, label, or physiologic property to a peptide.

Identifying sequence homology can be important for determining key residues that preserve tumor homing function.

Two or more peptides can share a degree of homology and share similar properties in vivo. For instance, a peptide can share a degree of homology with a peptide of the present disclosure. In some cases, a peptide of the disclosure can have up to about 20% pairwise homology, up to about 25% pairwise homology, up to about 30% pairwise homology, up to about 35% pairwise homology, up to about 40% pairwise homology, up to about 45% pairwise homology, up to about 50% pairwise homology, up to about 55% pairwise homology, up to about 60% pairwise homology, up to about 65% pairwise homology, up to about 70% pairwise homology, up to about 75% pairwise homology, up to about 80% pairwise homology, up to about 85% pairwise homology, up to about 90% pairwise homology, up to about 95% pairwise homology, up to about 96% pairwise homology, up to about 97% pairwise homology, up to about 98% pairwise homology, up to about 99% pairwise homology, up to about 99.5% pairwise homology, or up to about 99.9% pairwise homology with a second peptide. In some cases, a peptide of the disclosure can have at least about 20% pairwise homology, at least about 25% pairwise homology, at least about 30% pairwise homology, at least about 35% pairwise homology, at least about 40% pairwise homology, at least about 45% pairwise homology, at least about 50% pairwise homology, at least about 55% pairwise homology, at least about 60% pairwise homology, at least about 65% pairwise homology, at least about 70% pairwise homology, at least about 75% pairwise homology, at least about 80% pairwise homology, at least about 85% pairwise homology, at least about 90% pairwise homology, at least about 95% pairwise homology, at least about 96% pairwise homology, at least about 97% pairwise homology, at least about 98% pairwise homology, at least about 99% pairwise homology, at least about 99.5% pairwise homology, at least about 99.9% pairwise homology with a second peptide. Various methods and software programs can be used to determine the homology between two or more peptides, such as NCBI BLAST, Clustal W, MAFFT, Clustal Omega, AlignMe, Praline, or another suitable method or algorithm.

In still other instances, the variant nucleic acid molecules that can code for a peptide of any one of SEQ ID NO: 1-SEQ ID NO: 1134, SEQ ID NO: 1243-SEQ ID NO: 1262, or SEQ ID NO: 1263-SEQ ID NO: 1316 can be identified by either a determination of the sequence identity or homology of the encoded peptide amino acid sequence with the amino acid sequence of any one of SEQ ID NO: 1-SEQ ID NO: 1134, SEQ ID NO: 1243-SEQ ID NO: 1262, or SEQ ID NO: 1263-SEQ ID NO: 1316, or by a nucleic acid hybridization assay. Such peptide variants can include those encoded by nucleic acid molecules (1) that remain hybridized with a nucleic acid molecule having the nucleotide sequence encoding a peptide of any one of SEQ ID NO: 1-SEQ ID NO: 1134, SEQ ID NO: 1243-SEQ ID NO: 1262, or SEQ ID NO: 1263-SEQ ID NO: 1316 (or any complement of the previous sequences) under stringent washing conditions, in which the wash stringency is equivalent to 0.5×-2×SSC with 0.1% SDS at 55-65° C., and (2) that encode a peptide having at least 70%, at least 80%, at least 90%, at least 95%, at least 96%, at least 97%, at least 98%, at least 99% or grater sequence identity or homology, or greater than 95% sequence identity or homology to the amino acid sequence of any one SEQ ID NO: 1-SEQ ID NO: 1134, SEQ ID NO: 1243-SEQ ID NO: 1262, or SEQ ID NO: 1263-SEQ ID NO: 1316. Alternatively, peptide variants of any one SEQ ID NO: 1-SEQ ID NO: 1134, SEQ ID NO: 1243-SEQ ID NO: 1262, or SEQ ID NO: 1263-SEQ ID NO: 1316 can be characterized as those encoded by nucleic acid molecules (1) that remain hybridized with a nucleic acid molecule having the nucleotide sequence of any one SEQ ID NO: 1-SEQ ID NO: 1134, SEQ ID NO: 1243-SEQ ID NO: 1262, or SEQ ID NO: 1263-SEQ ID NO: 1316 (or any complement of the previous sequences) under highly stringent washing conditions, in which the wash stringency is equivalent to 0.1×-0.2×SSC with 0.1% SDS at 50-65° C., and (2) that encode a peptide having at least 70%, at least 80%, at least 90%, at least 95%, at least 96%, at least 97%, at least 98%, at least 99% or grater sequence identity or homology, or greater than 95% sequence identity or homology to the amino acid sequence of any one of SEQ ID NO: 1-SEQ ID NO: 1134, SEQ ID NO: 1243-SEQ ID NO: 1262, or SEQ ID NO: 1263-SEQ ID NO: 1316.

Percent sequence identity or homology can be determined by conventional methods. See, for example, Altschul et al., *Bull. Math. Bio.* 48:603 (1986), and Henikoff and Henikoff,

*Proc. Natl. Acad. Sci. USA* 89:10915 (1992). Briefly, two amino acid sequences are aligned to optimize the alignment scores using a gap opening penalty of 10, a gap extension penalty of 1, and the "BLOSUM62" scoring matrix of Henikoff and Henikoff (Id.). The sequence identity or homology is then calculated as: ([Total number of identical matches]/[length of the longer sequence plus the number of gaps introduced into the longer sequence in order to align the two sequences])(100).

Additionally, there are many established algorithms available to align two amino acid sequences. For example, the "FASTA" similarity search algorithm of Pearson and Lipman is a suitable protein alignment method for examining the level of sequence identity or homology shared by an amino acid sequence of a peptide disclosed herein and the amino acid sequence of a peptide variant. The FASTA algorithm is described by Pearson and Lipman, Proc. Nat'l Acad. Sci. USA 85:2444 (1988), and by Pearson, Meth. Enzymol. 183:63 (1990). Briefly, FASTA first characterizes sequence similarity by identifying regions shared by the query sequence (e.g., SEQ ID NO: 1) and a test sequence that has either the highest density of identities (if the ktup variable is 1) or pairs of identities (if ktup=2), without considering conservative amino acid substitutions, insertions, or deletions. The ten regions with the highest density of identities are then rescored by comparing the similarity of all paired amino acids using an amino acid substitution matrix, and the ends of the regions are "trimmed" to include only those residues that contribute to the highest score. If there are several regions with scores greater than the "cutoff" value (calculated by a predetermined formula based upon the length of the sequence and the ktup value), then the trimmed initial regions are examined to determine whether the regions can be joined to form an approximate alignment with gaps. Finally, the highest scoring regions of the two amino acid sequences are aligned using a modification of the Needleman-Wunsch-Sellers algorithm (Needleman and Wunsch, *J. Mol. Biol.* 48:444 (1970); Sellers, Siam J. *Appl. Math.* 26:787 (1974)), which allows for amino acid insertions and deletions. Illustrative parameters for FASTA analysis are: ktup=1, gap opening penalty=10, gap extension penalty=1, and substitution matrix=BLOSUM62. These parameters can be introduced into a FASTA program by modifying the scoring matrix file ("SMATRIX"), as explained in Appendix 2 of Pearson, *Meth. Enzymol.* 183:63 (1990).

FASTA can also be used to determine the sequence identity or homology of nucleic acid molecules using a ratio as disclosed above. For nucleotide sequence comparisons, the ktup value can range between one to six, preferably from three to six, most preferably three, with other parameters set as described above.

Some examples of common amino acids that are a "conservative amino acid substitution" are illustrated by a substitution among amino acids within each of the following groups: (1) glycine, alanine, valine, leucine, and isoleucine, (2) phenylalanine, tyrosine, and tryptophan, (3) serine and threonine, (4) aspartate and glutamate, (5) glutamine and asparagine, and (6) lysine, arginine and histidine. The BLOSUM62 table is an amino acid substitution matrix derived from about 2,000 local multiple alignments of protein sequence segments, representing highly conserved regions of more than 500 groups of related proteins (Henikoff and Henikoff, *Proc. Nat'l Acad. Sci. USA* 89:10915 (1992)). Accordingly, the BLOSUM62 substitution frequencies can be used to define conservative amino acid substitutions that can be introduced into the amino acid sequences of the present invention. Although it is possible to design amino acid substitutions based solely upon chemical properties (as discussed above), the language "conservative amino acid substitution" preferably refers to a substitution represented by a BLOSUM62 value of greater than −1. For example, an amino acid substitution is conservative if the substitution is characterized by a BLOSUM62 value of 0, 1, 2, or 3. According to this system, preferred conservative amino acid substitutions are characterized by a BLOSUM62 value of at least 1 (e.g., 1, 2 or 3), while more preferred conservative amino acid substitutions are characterized by a BLOSUM62 value of at least 2 (e.g., 2 or 3).

Determination of amino acid residues that are within regions or domains that are critical to maintaining structural integrity can be determined. Within these regions one can determine specific residues that can be more or less tolerant of change and maintain the overall tertiary structure of the molecule. Methods for analyzing sequence structure include, but are not limited to, alignment of multiple sequences with high amino acid or nucleotide identity or homology and computer analysis using available software (e.g., the Insight II® viewer and homology modeling tools; MSI, San Diego, Calif.), secondary structure propensities, binary patterns, complementary packing and buried polar interactions (Barton, G. J., *Current Opin. Struct. Biol.* 5:372-6 (1995) and Cordes, M. H. et al., *Current Opin. Struct. Biol.* 6:3-10 (1996)). In general, when designing modifications to molecules or identifying specific fragments determination of structure can typically be accompanied by evaluating activity of modified molecules.

Pairwise sequence alignment can be used to identify regions of similarity that can indicate functional, structural and/or evolutionary relationships between two biological sequences (protein or nucleic acid). By contrast, multiple sequence alignment (MSA) is the alignment of three or more biological sequences. From the output of MSA applications, homology can be inferred and the evolutionary relationship between the sequences assessed. One of skill in the art would recognize as used herein, "sequence homology" and "sequence identity" and "percent (%) sequence identity" and "percent (%) sequence homology" have been used interchangeably to mean the sequence relatedness or variation, as appropriate, to a reference polynucleotide or amino acid sequence.

Likewise, the peptide-I/O complexes can be modified by the same methods described herein for the peptides of this disclosure, as applied to polynucleotides of any polynucleotide length, chemistry, or structure (e.g., natural or non-natural DNA or RNA, single stranded, double stranded, triple stranded or more, primary, secondary or tertiary polynucleotide structures, or any combination thereof).

Any peptide or peptide-I/O complex of the present disclosure, such as SEQ ID NO: 1 or any one of SEQ ID NO: 1-SEQ ID NO: 1134, SEQ ID NO: 1243-SEQ ID NO: 1262, or SEQ ID NO: 1263-SEQ ID NO: 1316, can be internalized by tumor cells and, as such, be cell penetrating. Any peptide or peptide-I/O complex of the present disclosure, such as SEQ ID NO: 1 or any one of SEQ ID NO: 1-SEQ ID NO: 1134, SEQ ID NO: 1243-SEQ ID NO: 1262, or SEQ ID NO: 1263-SEQ ID NO: 1316, can be internalized in a clathrin-dependent manner or by another mechanism into the endosomal compartment. Endosomal trafficking pathways and endosomal trafficking pathways that can be accessed by a peptide or a peptide-I/O complex of the present disclosure are discussed in Hu et al. (Transl Neurodegener. 2015 Sep. 30; 4:18) and Juliano et al. (Nucleic Acids Res. 2016 Aug. 19; 44(14):6518-48). Following internalization, into early endosomes, different cargoes have different fates; they can be escorted to the lysosome for degradation, recycled to the cell membrane or exterior, such as for FcRn, or selected proteins can be sorted by the retromer complex to the trans-Golgi network for retrieval. The vesicles leading to the lysosome, including the multivesicular bodies and late endosomes, become increasingly acidic, leading to dissociation of receptor-ligand complexes, as they move to the lysosome. Content of enzymes also changes as vesicles move from endosome to lysosomes. The dissociated receptors may be recycled via the retromer complex and Rab7 back to the Golgi (Purushothaman 2018). Early endosomes can recycle proteins to the cell surface directly. A peptide can also be transported to the perinuclear Golgi or trans-Golgi network (TGN) following a pathway known as "retrograde transport." Endosomal trafficking pathways can result in recycling of proteins to the cell surface or extracellular space, or in entry of peptides or dissociated ligands into the cytosol. Endosomes can also acidify into lysosomes and a peptide can, thus, be degraded by the cell. Acidification in endosomes can create an environment in which an acid labile linker, such as an acid labile linker that connects a peptide and an immuno-oncology (I/O) agent, can be cleaved. The endosomal-lysosomal pathway can involve a gradual decrease in pH and increase in levels of various proteases, which can enable pH sensitive cleavage, protease-mediated cleavage, or cleavage of labile bonds by other mechanisms. Peptides, and peptide-I/O complexes, of the present disclosure can also enter the cytoplasm by other mechanisms, such as caveolae, pinocytosis, direct penetration, energy-dependent or independent mechanisms, by other mechanisms of translocation, or any combination thereof. Moreover, peptide-I/O complexes can be designed to be presented on cell surfaces (via the endosomal, TGN, or lysosomal pathways) to activate physiologic I/O responses at the cell surface or to be secreted back into the tumor microenvironment (for example, with a peptide-I/O complex comprising an IL-15 agent of the present disclosure or a 4-1BB ligand of the present disclosure as the I/O) or internally such as in the cytoplasm (for example, with a peptide-I/O complex comprising RIG-I ligand I/O of the present disclosure or a STING ligand I/O of the present disclosure) as needed. Moreover, peptide-I/O complexes can be designed for intracellular activation and degradation to target I/Os with intracellular sites of action, for example, in cancer therapy. As such, the peptide-I/O complexes of the present disclosure can effectively be targeted to deliver an I/O to a solid or liquid tumor, to a tumor microenvironment, to tumor tissues, cells, cellular compartments, the cytosol, within tumor cells, to certain compartments or locations within a tumor cell, or any combination thereof, in order to deliver I/Os to sites of action including, optionally, via the endosomal, TGN, and/or lysosomal pathways.

Different I/Os agents can be delivered to different subcellular compartments, which can be due to various cell penetrating properties. Desired targeting can include the subcellular delivery of I/Os include RIG-I or STING ligands to the cytoplasm, IL-15 agents for cell surface presentation or secretion to the extracellular tumor microenvironment, or 4-1BB ligand for cell surface presentation or secretion. These, and other, I/O agents can be delivered to the endosomal network of tumor cells, via a peptide described herein. Once inside the endosome network, the peptide-I/O complex can be directed to its final destination based on the molecular design. In some instances, the peptide-I/O complex, wherein the I/O comprises a RIG-I ligand, can be fully active with the peptide still complexed to the RIG-I ligand and without any processing. These constructs can escape from endosomes to the cytoplasm which can be aided by the presence of a peptide described herein. Optionally the peptide of a peptide-I/O complex described herein can be processed so as to be removed, degraded, or dissociated by enzymes or chemically within the endosomes, lysosome, or after delivery to the cytoplasm. To increase the efficiency of cytoplasmic delivery, modifications may optionally be added to the peptide-I/O complex, such as cell penetrating peptides or modification of the amino acid sequence of the peptide, usage of hydrophobic linkers, or formulations of the peptide-I/O complex. For peptide-IL-15 agent complexes to exert their signaling on the immune system, the IL-15 agent can be presented in the extracellular tumor microenvironment, optionally by being secreted or presented on the cell surface. In addition, IL-15 agents can demonstrate toxicity in systemic circulation. The design of the peptide-I/O complex, wherein the I/O comprises an IL-15 agent (peptide-IL-15 agent complex) may include the placement of the peptide within the peptide-I/O complex at a position to inhibit IL-15 agent activity until processing (such as intracellular in tumor cells or in the tumor microenvironment) occurs resulting in activation of the IL-15 agent activity. As such, the peptide-IL-15 agent complex may serve as an IL-15 agent prodrug. Processing by an enzyme, such as cathepsin B, during endosomal processing, or by extracellular cathepsin or other enzyme present on the cell surface or in the tumor microenvironment, can release the peptide portion of the peptide-IL-15 agent complex and increase the potency of the remaining IL-15 agent construct. As such, reduced exposure to an IL-15 agent potency may be experienced systemically or in other organs whereas a higher potency exposure to the IL-15 agent can be experienced in the tumor microenvironment, thus targeting the efficacy of IL-15 agent to the tumor and reducing toxicity at other sites. Processing by Cathepsin B may be chosen because it is present throughout the endosomal system including early endosomes, enabling processing without requiring that the protein move into an acidic compartment such as the lysosome. (Blum 1991, Lautwein 2004, Guha 2008, Diederich 2012). The properties of a peptide described herein optionally combined with a peptide dissociating protease cleavage site or other cleavage site can determine the subcellular sorting pathway. Cathepsin B is also found at the cell surface or pericellular space in many cancers (Fonovic and Turk, Biochim Biophys Acta 1840:2560-2570 (2014)). Therefore cleavage of the peptide-I/O complex prodrug can take place prior to internalization, or after internalization and secretion. In these cases the peptide-I/O complex targets the prodrug to the tumor, where it undergoes processing in the pericellular space, resulting in therapeutic levels of the I/O (e.g., IL-15 agents) in the tumor microenvironment. Other enzymes present in the endosomal/lysosomal pathway, or present in the tumor microenvironment or pericellular space, may also be targeted for the processing mechanism of a prodrug. These enzymes include, but are not limited to, glucuronidases including beta-glucuronidase, hyaluronidase and matrix metalloproteases (MMP), such as MMP-1, 2, 7, 9, 13, or 14.

A peptide of this disclosure can also include non-natural, non-common, or modified amino acids, such as any amino acid that is not part of the 20 canonical amino acids. The non-natural amino acid can include a unique functional group for chemical conjugation or to change the biophysical or biochemical properties of the protein, such as binding interactions, stability, or conformation. The non-natural amino acid can be incorporated recombinantly, synthetically, or can be introduced enzymatically. A non-natural amino acid can include, but is not limited to, azidohomoalanine, homopropargylglycine, p-acetyl-phenylalanine, or fluoroalanine, and can include, but is not limited to, an azide, alkyne, ketone, or aldehyde functional group, or any combination thereof. A non-common amino acid can include, but is not limited to, an amino acid precursor or intermediate, citrulline (Cit; often designated as X), selenocysteine (U; Sec) and pyrrolysine (O; Pyl), or any combination thereof.

A peptide of the present disclosure can more effectively target an immunooncology agent (I/O) to a tumor microenvironment, to tumor tissues, cells, cellular compartments, the cytosol, within tumor cells or to certain compartments or locations within a tumor cell, and/or across the blood brain barrier (BBB) as compared to I/Os without the peptide. A peptide of the present disclosure can also exhibit higher and more consistent uptake by tumor cells, thereby leading to higher intracellular delivery of complexed I/Os. Moreover, a peptide of the present disclosure can have reduced off-target accumulation. A peptide-I/O complex of this present disclosure can also have lower potency until it is processed or modified in the tumor cells or tumor microenvironment. As a result of any of these effects, administration of a peptide-I/O complex of the present disclosure can have reduced toxicity in off-target, normal tissues as compared to free I/Os.

A peptide of the present disclosure can be linked to the surface of a lipid nanoparticle that can comprise an I/O. The lipid nanoparticle can then be directed to tumor cells, where it can be internalized and deliver the I/O directly to the cytoplasm. Additionally, a peptide-I/O complex of the present disclosure can deliver the I/O more efficiently into the cytoplasm or cellular compartments than the I/O without the peptide, enabling delivery of sufficient levels of the I/O to a tumor to have a therapeutic effect.

In addition, a peptide or peptide-I/O complex of this disclosure can be modified to further enhance cellular penetration, cytosolic delivery, endosomal uptake, or endosomal escape, and delivery of the I/O to the cytoplasm or to other subcellular compartments. Delivery of the I/O to the cytoplasm may be necessary in order to activate the desired pathway, such as activating the RIG-I pathway. For instance, a peptide that can enhance cell penetration can be fused or conjugated to the peptide or the peptide-I/O complex to enhance cell penetration. Such a cell penetrating peptide can be placed in the linker between the peptide and the I/O agent in the peptide-I/O complex, or on either or both of the I/O agent or on the peptide in the peptide-I/O complex, optionally with linkers in between. One or more than one or optionally 1-10 of such cell penetrating peptides could be added to a peptide-I/O complex. Exemplary cell penetration enhancing peptides can include, but are not limited to, Tat (GRKKRRQRRRPPQ, SEQ ID NO: 1207), oligo-Arg, which is $R_x$ ($R_x$, where x=6-12 (SEQ ID NO: 1382), or x=3-20 (SEQ ID NO: 1495) or more R (Arg) residues), penetratin (RQIKIWFQNRRMKWKK, SEQ ID NO: 1208), pVEC (LLIILRRRIRKQAHAHSK, SEQ ID NO: 1209), transportan (GWTLNSAGYLLGKINLKALAALAKKIL, SEQ ID NO: 1210), MPG (GALFLGFLGAAGSTMGAWSQPKKKRKV, SEQ ID NO: 1211), Pep-1 (KETWWETWWTEWSQPKKKRKV, SEQ ID NO: 1212), MAP (KLALKLALKALKAALKLA, SEQ ID NO: 1213), and R6W3 (RRWWRRWRR, SEQ ID NO: 1214), Oct4 (DVVRVWFCNRRQKGKR, SEQ ID NO: 1215), WT1-pTj (KDCERRFSRSDQLKRHQRRHTGVKPFQ, SEQ ID NO: 1216), DPV3 (RKKRRRESRKKRRRES, SEQ ID NO: 1217), VP22 (DAATATRGRSAASRPTERPRAPARSASRPRRPVE, SEQ ID NO: 1218), KW (KRKRWHW, SEQ ID NO: 1219), KFGF (AAVLLPVLLAAP, SEQ ID NO: 1220), FGF12 (PIEVCMYREP, SEQ ID NO: 1221), Integrin beta3 peptide (VTVLALGALAGVGVG, SEQ ID NO: 1222), C105Y (PFVYLI, SEQ ID NO: 1223), and TP2 (PLIYLRLLRGQF, SEQ ID NO: 1224), and any other peptides as described in Raucher et al. (Trends Mol Med. 2015 September; 21(9):560-70), Ramsey et al. (Pharmacol Ther. 2015 October; 154:78-86), Bechara et al. (FEBS Lett. 2013 Jun. 19; 587(12):1693-702). Other exemplary cell penetrating peptides can also include cysteine-dense peptides such as imperatoxin A, maurocalcine, MCoTI-II, EETI-II, kalata B1, SFTI-1, and CyLoP-1.

A number of cell penetrating peptides (CPPs), can serve as delivery vehicles to facilitate cellular intake/uptake of the peptide-I/O complexes disclosed herein, or translocation of the peptide-I/O complexes across cell membranes, or delivery of the peptide-I/O complex to the cytosol or subcellular compartments. Some CPPs which are 8-30 amino acids long with cationic or amphipathic sequences, have been described that can deliver cargo across the membrane. Such cargo includes peptides, proteins, oligonucleotides, polynucleotides, and various small molecules. Typically, these CPPs facilitate entry of the CPP-cargo into the endosomal compartment, where they accumulate or are processed. Additional modifications are required, in some cases, to efficiently deliver cargo across the endosomal membrane to the cytoplasm or nucleus. One example is derived from HIV TAT (Sawant 2010, Rizzuti 2015). TAT peptides efficiently enable localization into the endosome but are not very efficient at cytoplasmic delivery. Dimerization of this TAT peptide enhances cytoplasmic penetration (Monreal 2015, Kim 2018, Erazo-Oliveras 2014).

CPPs, which can be used for delivery of peptide-I/O complexes described herein, including the TAT peptides, such as the arginine-rich sequence TATp 48-60: GRKKRRQRRRPPQ (SEQ ID NO: 1207) and the best known TAT peptide CPP, YGRKKRRQRRR (SEQ ID NO: 1395), and CGYGRKKRRQRRRGC (SEQ ID NO: 1492) (TAT), GVFVLGFLGFLA (fusogenic peptide of HIV bp160 envelope protein; SEQ ID NO: 1384), cationic Arg rich and hydrophobic peptides to enhance endocytosis and endosomal release such as RRRRRRRR: (R8; SEQ ID NO: 1385), DSHAKRHHGYKRKFHEKHHSHRGY (Histatin 5 and derivative peptide; den Hertog 2004; SEQ ID NO: 1386), KRLFKKLLFSLRKY (dhvar4; SEQ ID NO:1387), CIGAVLKVLTTGLPALISWIKRKRQQ (melittin; SEQ ID NO: 1388), CLIKKALAALAKLNIKLLYGASNLTWG (transportan; SEQ ID NO: 1389), YKQSHKKGGKKGSG (NrTP6-C nucleolar targeting peptide; Rodrigues 2011; SEQ ID NO: 1390), (VRLPPP)3 (proline rich peptide derived from maize γ-zein; Fernpndez-Carneado 2004; SEQ ID NO: 1391), VSRRRRRRGGRRRR (low molecular weight protamine; SEQ ID NO: 1392), EARPALLTSRLRFIPK (GV1001 is a peptide which corresponds to residues 611-626 of the human telomerase reverse transcriptase (hTERT) protein; SEQ ID NO: 1393), KALLAL (Grijalvo 2018; SEQ ID NO: 1394), CPPs as listed in TABLE 2 below (from Peraro 2018) YGRKKRRQRRR (TAT; SEQ ID NO: 1395), RRRRRRRRR (R9; SEQ ID NO: 1396), AGYLLGKINLKALAALAKKIL (TP10; SEQ ID NO: 1397), LSTAADMQGVVTDGMASGLDKDYLKPDD (P28; SEQ ID NO:1398), CSIPPEVKFNKPFVYLI (C105Y; SEQ ID NO: 1399), and SDLWEMMMVSLACQY (Pep-7; SEQ ID NO: 1400).

Other TAT peptides that are consistent with the present disclosure include GRKKRRQRRRPQ (SEQ ID NO: 1487), GRKKRRQRRRP (SEQ ID NO: 1488), GRKKRRQRRRG (SEQ ID NO: 1489), CGYGRKKRRQRRRGC (SEQ ID NO: 1492), RKKRRQRRR (SEQ ID NO: 1490) and others. Many cell penetrating peptide sequences are listed on CPP-site 2.0 (http://crdd.osdd.net/raghava/cppsite/index.html) and key sequences are listed below.

CPPs of the present disclosure may also include other cell penetrating compounds as reviewed by Varkouhi (2011), which is incorporated herein in its entirey. CPPs of the present disclosure may also include those mentioned in CPPsite 2.0 database (http://crdd.osdd.net/raghava/cppsite/) described by Agrawal (2016), both of which are incorporated herein in their entirety.

Any of the above peptides, combined with a peptide-I/O complex of this disclosure, may enhance the delivery of cargo across the membrane, into the cytoplasm. Using CPPs for delivery of the peptide-I/O complexes can be desired for I/O agents with intracellular targets, such as RIG-I, MDA5, and STING.

A summary of cell penetrating peptides, which can be used in conjunction with the peptide-I/O complexes of the present disclosure are shown below in TABLE 2.

TABLE 2

Additional Cell Penetrating Peptides

| SEQ ID NO | Name | Sequence |
|---|---|---|
| SEQ ID NO: 1382 | | $R_x$, where x = 6-12 or more R residues |
| SEQ ID NO: 1207 | TAT p48-60 | GRKKRRQRRRPPQ |
| SEQ ID NO: 1208 | penetratin | RQIKIWFQNRRMKWKK |
| SEQ ID NO: 1209 | pVEC | LLIILRRRIRKQAHAHSK |
| SEQ ID NO: 1210 | transportan | GWTLNSAGYLLGKINLKALAALAKKIL |
| SEQ ID NO: 1211 | MPG | GALFLGFLGAAGSTMGAWSQPKKKRKV |
| SEQ ID NO: 1212 | Pep-1 | KETWWETWWTEWSQPKKKRKV |
| SEQ ID NO: 1213 | MAP | KLALKLALKALKAALKLA |
| SEQ ID NO: 1214 | R6W3 | RRWWRRWRR |
| SEQ ID NO: 1215 | Oct4 | DVVRVWFCNRRQKGKR |
| SEQ ID NO: 1216 | WT1-pTj | KDCERRFSRSDQLKRHQRRHTGVKPFQ |
| SEQ ID NO: 1217 | DPV3 | RKKRRRESRKKRRRES |
| SEQ ID NO: 1218 | VP22 | DAATATRGRSAASRPTERPRAPARSASRPRRPVE |
| SEQ ID NO: 1219 | KW | KRKRWHW |
| SEQ ID NO: 1220 | KFGF | AAVLLPVLLAAP |
| SEQ ID NO: 1221 | FGF12 | PIEVCMYREP |
| SEQ ID NO: 1222 | Integrin beta3 peptide | VTVLALGALAGVGVG |
| SEQ ID NO: 1399 | C105Y | CSIPPEVKFNKPFVYLI |
| SEQ ID NO: 1224 | TP2 | PLIYLRLLRGQF |
| SEQ ID NO: 1383 | C-TAT | CAYGRKKRRQRRRG |
| SEQ ID NO: 1384 | fusogenic peptide of HIV bp160 envelope protein | GVFVLGFLGFLA |
| SEQ ID NO: 1385 | R8 | RRRRRRRR |
| SEQ ID NO: 1386 | Histatin 5 and derivative peptide | DSHAKRHHGYKRKFHEKHHSHRGY |
| SEQ ID NO: 1387 | dhvar4 | KRLFKKLLFSLRKY |
| SEQ ID NO: 1388 | melittin | CIGAVLKVLTTGLPALISWIKRKRQQ |
| SEQ ID NO: 1389 | transportan | CLIKKALAALAKLNIKLLYGASNLTWG |

TABLE 2-continued

Additional Cell Penetrating Peptides

| SEQ ID NO | Name | Sequence |
|---|---|---|
| SEQ ID NO: 1390 | NrTP6-C nucleolar targeting peptide | YKQSHKKGGKKGSG |
| SEQ ID NO: 1391 | proline rich peptide derived from maize γ-zein | (VRLPPP)3 |
| SEQ ID NO: 1392 | low molecular weight protamine | VSRRRRRRGGRRRR |
| SEQ ID NO: 1393 | GV1001 is a peptide which corresponds to residues 611-626 | EARPALLTSRLRFIPK |
| SEQ ID NO: 1394 | | KALLAL |
| SEQ ID NO: 1395 | TAT | YGRKKRRQRRR |
| SEQ ID NO: 1396 | R9 | RRRRRRRRR |
| SEQ ID NO: 1397 | TP10 | AGYLLGKINLKALAALAKKIL |
| SEQ ID NO: 1398 | P28 | LSTAADMQGVVTDGMASGLDKDYLKPDD |
| SEQ ID NO: 1399 | C105Y | CSIPPEVKFNKPFVYLI |
| SEQ ID NO: 1400 | Pep-7 | SDLWEMMMVSLACQY |
| SEQ ID NO: 1208 | pAntp | RQIKIWFQNRRMKWKK |
| SEQ ID NO: 1442 | 1A | CSSLDEPGRGGFSSESKV |
| SEQ ID NO: 1443 | hLF WT | KCFQWQRNMRKVRGPPVSCIKR |
| SEQ ID NO: 1444 | Xentry | LCLRPVG |
| SEQ ID NO: 1445 | VG-21 | VTPHHVLVDEYTGEWVDSQFK |
| SEQ ID NO: 1446 | NrTP6 | YKQSHKKGGKKGSG |
| SEQ ID NO: 1447 | CyLoP-1 | CRWRWKCCKK |
| SEQ ID NO: 1448 | DPV6 | GRPRESGKKRKRKRLKP |
| SEQ ID NO: 1449 | DPV3/10 | RKKRRRESRRARRSPRHL |
| SEQ ID NO: 1450 | DPV10 | SRRARRSPRHLGSG |
| SEQ ID NO: 1451 | Inv3 | TKRRITPKDVIDVRSVITEINT |
| SEQ ID NO: 1452 | Bac15-24 | PRPLPFPRPG |
| SEQ ID NO: 1453 | ERNS7 | GRQLRIAGRRLRGRSR |
| SEQ ID NO: 1454 | Res3 | KLIKGRTPIKFGKADCDRPPKHSQNGK |
| SEQ ID NO: 1455 | RSV-A6 | KRIPNKKPGKKT |
| SEQ ID NO: 1456 | RSV-A9 | RRIPNRRPPR |
| SEQ ID NO: 1457 | RSV-B2 | KTIPSNKPKKK |
| SEQ ID NO: 1458 | RSG 1.2 | DRRRGSRPSGAERRRR |
| SEQ ID NO: 1459 | FHV-TA (39-49) | NRARRNRRRVR |
| SEQ ID NO: 1460 | Bipartite nucleoplasmin NLS | KRPAAIKKAGQAKKKK |

TABLE 2-continued

Additional Cell Penetrating Peptides

| SEQ ID NO | Name | Sequence |
|---|---|---|
| SEQ ID NO: 1461 | ALPHA Virus nucelocapsid | KCPSRRPKR |
| SEQ ID NO: 1462 | Herpesvirus 8 k8 protein | TRRSKRRSHRKF |
| SEQ ID NO: 1463 | Cyt C 71-101 | GTKMIFVGIKKKEERADLIAYLKKA |
| SEQ ID NO: 1464 | P22 N | NAKTRRHERRRKLAIERGC |
| SEQ ID NO: 1465 | LAMBDA N | MDAQTRRRERRAEKQAQWKAANGC |
| SEQ ID NO: 1466 | PHI 21 N | TAKTRYKARRAELIAERRGC |
| SEQ ID NO: 1467 | C Jun | RIKAERKRMRNRIAASKSRKRKLERIARGC |
| SEQ ID NO: 1468 | Yeast GCN 4 | KRARNTEAARRSRARKLQRMKQGC |
| SEQ ID NO: 1469 | CADY | GLWRALWRLLRSLWRLLWRA |
| SEQ ID NO: 1470 | VP22 | DAATATRGRSAASRPTQRPRAPARSASRPRRPVE |
| SEQ ID NO: 1471 | F3 | AKVKDEPQRRSARLSAKPAPPKPEPKPKKAPAKK |
| SEQ ID NO: 1472 | PreS2 | PLSSIFSRIGDP |
| SEQ ID NO: 1473 | TFIIE BETA | SKKKKTKV |
| SEQ ID NO: 1474 | 6-Oct | GRKRKKRT |
| SEQ ID NO: 1475 | NF-kB | VQRKRQKLMP |
| SEQ ID NO: 1476 | (1-9)-(38-42) Crot | YKQCHKKGGKKGSG |
| SEQ ID NO: 1477 | EB-1 | LIRLWSHLIHIWFQNRRLKWKKK |
| SEQ ID NO: 1478 | HIV-1 Rev | TRQARRNRRRWRERQRGC |
| SEQ ID NO: 1479 | FHV coat | RRRRNRTRRNRRRVRGC |
| SEQ ID NO: 1480 | BMV Gag | KMTRAQRRAAARRNRWTARGC |
| SEQ ID NO: 1481 | HTLV-II Rex | TRRQRTRRARRNRGC |
| SEQ ID NO: 1482 | CPP-PNA | KFFKFFKFFK |
| SEQ ID NO: 1483 | LB$_{1\_1}$ | RXRRXRILFQYRXRRXR |
| SEQ ID NO: 1484 | LB$_{1\_2}$ | RXRRXRYQFLIRXRRXR |
| SEQ ID NO: 1485 | LB$_{1\_5}$ | RXRRXRIKFQYRXRRXR |
| SEQ ID NO: 1486 | LB$_{1\_7}$ | RXRRXRIWFQYRXRRXR |
| SEQ ID NO: 1401 | dhvar5 | LLLFLLKKRKKRKY |
| SEQ ID NO: 1402 | HPV3 3L2 | SYFILRRRKKRFPY |
| SEQ ID NO: 1403 | HPV1 6L2 | SYYMLRKRRKRLPY |
| SEQ ID NO: 1404 | hpv1 8L2 | LYYFIRKKRKRVPY |
| SEQ ID NO: 1405 | SV5 | FAGVVIGLAALGVATAAQVTAAVALV |
| SEQ ID NO: 1406 | NDV | FIGAIIGSVALGVATAAQITAASALI |
| SEQ ID NO: 1407 | HPIV3 | FFGGVIGTIALGVATSAQIYAAVALV |
| SEQ ID NO: 1408 | Measles | FAGVVLAGAALGVATAAQITAGIALH |
| SEQ ID NO: 1409 | Nipah | LAGVIMAGVAIGIATAAQITAGVALY |

TABLE 2-continued

Additional Cell Penetrating Peptides

| SEQ ID NO | Name | Sequence |
|---|---|---|
| SEQ ID NO: 1410 | FP1 | SFIEDLLFNKVTLADAGFMKQY |
| SEQ ID NO: 1411 | FP2 | KQYGECLGDINARDLICAQKF |
| SEQ ID NO: 1412 | Inf HA2 | GLFGAIAGFIENGWEGMIDGWYG |
| SEQ ID NO: 1413 | diINF-7 | GLFEAIEGFIENGWEGMIDGWYGC |
| SEQ ID NO: 1414 | peptide analogue resembling Inf HA-2 dimerized at the COOH terminus by disulfide bond formation between COOH-terminal cysteine residues | GLFEAIEGFIENGWEGMIDGWYGC |
| SEQ ID NO: 1415 | Endosomal escape domain (EED) | GFFG |
| SEQ ID NO: 1416 | Endosomal escape domain (EED) | GWG |
| SEQ ID NO: 1417 | Endosomal escape domain (EED) | GFWG |
| SEQ ID NO: 1418 | Endosomal escape domain (EED) | GFWFG |
| SEQ ID NO: 1419 | Endosomal escape domain (EED) | GWWG |
| SEQ ID NO: 1420 | Endosomal escape domain (EED) | GWGGWG |
| SEQ ID NO: 1421 | Endosomal escape domain (EED) | GWWWG |
| SEQ ID NO: 1422 | synthetic peptide | FFLIPKG |
| SEQ ID NO: 1423 | cleavable GKPILFF sequence from Cathepsin D | GKPILFF |
| SEQ ID NO: 1487 | TAT peptide | GRKKRRQRRRPQ |
| SEQ ID NO: 1488 | TAT peptide | GRKKRRQRRRP |
| SEQ ID NO: 1489 | TAT peptide | GRKKRRQRRRG |
| SEQ ID NO: 1490 | TAT peptide | RKKRRQRRR |
| SEQ ID NO: 1505 | Maurocalcine | GDCLPHLKLCKENKDCCSKKCKRRGTNIEKRCR |
| SEQ ID NO: 1506\ | Imperatoxin | GDCLPHLKRCKADNDCCGKKCKRRGTNAEKRCR |
| SEQ ID NO: 1507 | Hadrucalcin | SEKDCIKHLQRCRENKDCCSKKCSRRGTNPEKRCR |

TABLE 2-continued

Additional Cell Penetrating Peptides

| SEQ ID NO | Name | Sequence |
| --- | --- | --- |
| SEQ ID NO: 1508 | Hemicalcin | TDDEEARWIEKRGDCLPHLKLCKADKDC CSKKCKRRGTNPEKRCR |
| SEQ ID NO: 1509 | Opicalcin-1 | GDCLPHLKRCKENNDCCSKKCKRRGTNP EKRCR |
| SEQ ID NO: 1510 | Opicalcin-2 | GDCLPHLKRCKENNDCCSKKCKRRGANP EKRCR |
| SEQ ID NO: 1511 | Midkine (62-104) | CGAQTQRIRCRVPCNWKKEFGADCKYKF ENWGACDGGTGTKVRQ |
| SEQ ID NO: 1512 | MCoTI-II | SGSDGGVCPKILKKCRRDSDCPGACICRG NGYCG |

Viral vectors are an efficient way to deliver nucleic acid molecules to the cytoplasm and nucleus of target cells. The development of new strategies for promoting gene delivery in contrast with the use of viral vectors can use both formulation and covalent approaches. Viral envelope proteins are able to direct the fusion with the endosomal membrane and enable pore formation for insertion of viral nucleic acid. These proteins have key peptide sequences that are responsible for membrane fusion. One is the hydrophobic fusogenic helix peptide at the N terminus of HIV and SIV gp160 transmembrane envelope protein, a pH-dependent fusion peptide (GVFVLGFLGFLA; SEQ ID NO: 1384) that was found to locally disorganize the lipid layer, a necessary step in the fusion process (Horth 1991). Other enveloped viruses also use pH dependent fusion peptides to penetrate the cytoplasm from the acidified endosomes. These include influenza virus and its fusion peptide of hemagglutinin A, and the F peptide of paramyxovirus F, SARS spike glycoprotein S, papillomavirus minor capsid protein L2 (Kamper 2006), and Ebola GP2 (Lamb 2007). These viruses use various strategies to transport viral genetic material into the cell, but they all require insertion and disruption of the endosomal membrane. Such membrane disruptive viral peptides, combined with a peptide-I/O complex of this disclosure, can enhance the delivery of cargo across the membrane, into the cytoplasm.

Using viral proteins for delivery of the peptide-I/O complexes can be desired for delivering I/O agents with intracellular targets, such as RIG-I, MDA5, and STING. Viral proteins for delivery of peptide-I/O complexes can include the L2 capsid peptides of HPV that show similarity to the histatin 5 peptide that is a human salivary antimicrobial peptide and its derivative peptide, dhvar5, LLL-FLLKKRKKRKY (dhvar5; SEQ ID NO: 1401). The HPV L2 capsid peptides include (Kamper 2006): SYFILRRRRKRFPY (HPV3 3L2; SEQ ID NO: 1402), SYYMLRKRRKRLPY (HPV1 6L2; SEQ ID NO: 1403), LYYFIRKKKRKRVPY (hpv1 8L2; SEQ ID NO: 1404).

Comparison of the amino acid sequences of the fusion peptides from the F proteins of representative members of the family Paramyxoviridae (Russell 2004) reveal viral proteins for delivery of peptide-I/O complex having the following sequences:

FAGVVIGLAALGVATAAQVTAAVALV, (SV5; SEQ ID NO: 1405)

FIGAIIGSVALGVATAAQITAASALI, (NDV; SEQ ID NO: 1406)

FFGGVIGTIALGVATSAQIYAAVALV, (HPIV3; SEQ ID NO: 1407)

FAGVVLAGAALGVATAAQITAGIALH, (Measles; SEQ ID NO: 1408)
and

LAGVIMAGVAIGIATAAQITAGVALY. (Nipah; SEQ ID NO: 1409)

Viral proteins for delivery of peptide-I/O complex can include the SARS S protein, which has two fusion peptides, F1 and F2 that act in a concerted manner (Lai 2017) including:

SFIEDLLFNKVTLADAGFMKQY (FP1; SEQ ID NO: 1410)
and

KQYGECLGDINARDLICAQKF. (FP2; SEQ ID NO: 1411)

Viral proteins for delivery of peptide-I/O complex can include Inf HA-2, which is the amino-terminal sequence of Influenza virus X-31 (H3N2) hemagglutinin subunit HA-2. The corresponding dimeric analog peptide diINF-7, of Inf HA-2, dimerized at the COOH terminus by disulfide bond formation between COOH-terminal cysteine residues is also used for delivery of I/O agents to the cell cytoplasm. These peptides have sequences as follows: GLFGAIAGFIEN-GWEGMIDGWYG (Inf HA2; SEQ ID NO: 1412), GLFEAIEGFIENGWEGMIDGWYGC (diINF-7; SEQ ID NO: 1413) as described (Mastrobattista 2002).

Any of the above peptides (e.g., any one of SEQ ID NO: 1401-SEQ ID NO: 1414) can optionally be added to a peptide-I/O complex to aid in cytoplasmic delivery to the target.

The peptides of this disclosure, such as any one of SEQ ID NO: 1-SEQ ID NO: 1134, SEQ ID NO: 1243-SEQ ID NO: 1262, or SEQ ID NO: 1263-SEQ ID NO: 1316, can also be modified to further enhance endosomal membrane fusion and penetration. One relevant example is the modification of a monoclonal antibody (mAb) for cytoplasmic penetration, where observation of the low-efficiency level penetration by the mAb was increased by site specific modification of the mAb with tryptophan, lysine and histidine to improve mAb penetration into the cytoplasm (Kim 2016). A peptide of this disclosure can similarly be modified with Trp, Lys, and His residues at key positions to enhance its release in the early endosome, or to enhance membrane pore formation, or to enhance cytoplasmic penetration.

Endosomal escape domains (EEDs) can also be used to enhance delivery to the cytoplasm of an I/O agent or a peptide-I/O complex of this disclosure. Endosomal escape domains (EEDs) can consist of short hydrophobic amino acids sequences that are required for viral escape from endosomes. To optimize endosomal escape various EEDs were designed and conjugated to a CPP (e.g., TAT) at a fixed distance of at least six, twelve, and eighteen, polyethylene glycol (PEG) units. Peptides tested containing hydrophobic EEDs included -GFFG (SEQ ID NO: 1415), -GWG (SEQ ID NO: 1416), -GFWG (SEQ ID NO: 1417), -GFWFG (SEQ ID NO: 1418), -GWWG (SEQ ID NO: 1419), -GWGGWG (SEQ ID NO: 1420), and -GWWWG (SEQ ID NO: 1421). For optimal endosomal escape the peptides may contain amino acids with at least one aromatic indole rings and optionally two (e.g., GWWG; SEQ ID NO: 1419) or at least one indole ring and at least one and optionally two aromatic phenyl groups (e.g., GFWFG; SEQ ID NO: 1418) at a distance of at least six PEG units. For example, one group showed endosomal escape of peptides containing amino acids with two aromatic indole rings (GWWG; SEQ ID NO: 1419) or one indole ring and at least two aromatic phenyl groups (GFWFG; SEQ ID NO: 1418) at a fixed distance of six PEG units (Lönn, P. et al. 2016 Sci. Rep. 6, 32301).

Penetration-accelerating sequences (PAS) such as the synthetic peptide FFLIPKG (SEQ ID NO: 1422) derived from the cleavable GKPILFF (SEQ ID NO: 1423) sequence from Cathepsin D can also be used to enhance cytosolic entry of cationic CPPs (Takayama, K. et al. 2012 Mol. Pharm. 9, 1222-1230) in conjunction with the peptide-I/O complexes of this disclosure.

Additionally, elements associated with cell penetration can be grafted onto the peptides of this disclosure, such as by adding or modifying amino acids in the loop regions of the peptides of this disclosure to enhance cell penetration. These elements associated with cell penetration can include any of the elements associated with cell penetration of the cell penetrating peptides given above. In addition, non-peptidic molecules, including small molecules, polymers, lipids, etc. that enhance cell penetration can be combined with the peptide-I/O complexes of this disclosure. Also, elements associated with cell penetration, such as those described above or others, can be combined in a formulation and/or by non-covalent combinations, in addition to grafting and fusion approaches.

Polymers other than peptides such as Synthetic polymers have also been developed to mimic viral fusion peptides that deliver cargo to cytoplasm. (Bulmus 2006, Convertine 2009). Such polymers, such as have been designed to disrupt endosomal membranes and promote the delivery of oligo-nucleotides (such as RIG-I ligands) to the cytoplasm and nucleus. The gold standard example of such polymers include polyethyleneimine. This and other cationic polymers complex with the nucleic acid cargo and form nanoparticles. However, it may be the free polymer that enables endosomal release (Chen 2018). Many polymers use amide groups as a pH responsive group to facilitate endosomal release. Synthetic polymers have been developed to mimic viral fusion peptides that will lyse red blood cells at acid but not neutral pH (Bulmus 2006, Convertine 2009). Any of the above described polymers can be used as complexes, conjugates, or formulations with a peptide-I/O complexes of this disclosure to enhance cytoplasmic delivery.

In addition, hydrophobic domains may be added to a peptide-I/O of this disclosure to enhance endosomal escape, endosomal uptake, and/or cytoplasmic delivery. To improve the uptake and delivery of macromolecular complexes to the cytoplasm the inclusion of hydrophobic domains have been added to CPPs to enhance endosomal release. For example, N-terminal stearoylation of the CPP TP-10 can promote endosomal escape and delivery of a negatively charged oligonucleotide to the cytoplasm (Mae, M. et al. 2009 J. Control. Release, 143, 221-227.) Addition of hydrophobic domains can also facilitate cellular uptake, membrane permeabilization, endosomal release, and delivery to cytoplasm (de Paula, Bentley, and Mahata. RNA, 13:431-456 (2007). Hydrophobic domains of utility include lipids, fatty acids, cholesterol, lithocholic acid, lauric acid, docosahexaenoic acid, docosanoic acid, $(CH_2)_x$ where $x=1-40$. A hydrophobic domain can be in the linker, can be appended to the side of the linker or peptide or I/O agent, or to either end of the molecule. Multiple hydrophobic domains of various lengths can be added to aid in cell penetration, endosomal escape, endosomal uptake, or cytoplasmic delivery. The hydrophobic domain can contain a linear chain, cyclic domains (aromatic or nonaromatic), and optionally one or more double or triple bonds. Similarly, such hydrophobic domains can be used to facilitate cellular uptake, membrane permeabilization, endosomal release, and delivery to cytoplasm of the peptide-I/O complexes of this disclosure.

Chemical Modifications

A peptide of the present disclosure can be chemically modified. In some embodiments, the peptide can be mutated to add function, delete function, or modify the in vivo behavior of the peptide. One or more loops between the disulfide linkages can be modified or replaced to include active elements from other peptides (such as described in Moore and Cochran, Methods in Enzymology, 503, p. 223-251, 2012). Amino acids can also be mutated, such as to increase half-life or bioavailability, modify, add or delete binding behavior in vivo, add new targeting function, modify surface charge and hydrophobicity, and/or allow conjugation sites. N-methylation is one example of methylation that can occur in a peptide of the disclosure. In some embodiments, the peptide can be modified by methylation on free amines. For example, full methylation can be accomplished through the use of reductive methylation with formaldehyde and sodium cyanoborohydride. The N-terminus of a peptide of the disclosure can be blocked, such as by acetylation or methylation, in order to block reactions with the amine of the N-terminus during conjugation.

A chemical modification can, for instance, extend the terminal half-life, the absorption half-life, the distribution half-life of a peptide, or change the biodistribution or pharmacokinetic profile of a peptide. A chemical modification can comprise a polymer, a polyether, polyethylene glycol, a biopolymer, a polyamino acid, a fatty acid, a dendrimer, an Fc region, a simple saturated carbon chain such as palmitate or myristoleate, sugars, hyaluronic acid, or albumin. The chemical modification of a peptide with an Fc region can be a fusion Fc-peptide. A polyamino acid can include, for example, a polyamino acid sequence with repeated single amino acids (e.g., polyglycine), a polyamino acid sequence with mixed polyamino acid sequences (e.g., gly-ala-gly-ala (SEQ ID NO: 1496)) that may or may not follow a pattern, or any combination of the foregoing.

In some embodiments, a peptide of the present disclosure can be coupled (e.g., conjugated) to another moiety that, e.g., can modify or effect changes to the properties of the peptide. In certain embodiments, a peptide described herein can be attached to another molecule, such an I/O that provides a therapeutic effect against a cancer. In certain embodiments, a peptide described herein can be attached to an active agent, which can include but is not limited to: a peptide, an oligopeptide, a polypeptide, a polynucleotide, a polyribonucleotide, a DNA, a cDNA, a ssDNA, a RNA, a dsRNA, a hairpin RNA, a micro RNA, an oligonucleotide, an antibody, an antibody fragment, a single chain Fv, an aptamer, a cytokine, an enzyme, a growth factor, a chemokine, a neurotransmitter, a chemical agent, a fluorophore, a metal, a metal chelate, an X-ray contrast agent, a PET agent, a radioisotope, a photosensitizer, a radiosensitizer, a radionuclide chelator, a therapeutic small molecule, a steroid, a corticosteroid, an anti-inflammatory agent, an immune modulator, a protease inhibitor, an amino sugar, a chemotherapeutic, a cytotoxic chemical, a toxin, a tyrosine kinase inhibitor, an anti-infective agent, an antibiotic, an anti-viral agent, an anti-fungal agent, an aminoglycoside, a nonsteroidal anti-inflammatory drug (NSAID) such as ketorolac or ibuprofen, a statin, a nanoparticle, a liposome, a polymer, a biopolymer, a polysaccharide, a proteoglycan, a glycosaminoglycan, a dendrimer, a fatty acid, or an Fc region, or an active fragment or a modification thereof. In some embodiments, the peptide is covalently or non-covalently linked to an I/O or active agent, e.g., directly or via a linker or by formulation such as in a liposome. In some embodiments, the peptide can be expressed as a fusion protein with an I/O, e.g., a cytokine.

In some embodiments, a peptide of the present disclosure can be modified such that the modification increases the stability and/or the half-life of the peptide. In some embodiments, the attachment of a hydrophobic moiety, such as to the N-terminus, the C-terminus, or an internal amino acid, can be used to extend half-life of a peptide of the present disclosure. In other embodiments, the peptide of the present disclosure can include post-translational modifications (e.g., methylation and/or amidation), which can affect, e.g., serum half-life. In some embodiments, simple carbon chains (e.g., by myristoylation and/or palmitoylation) can be conjugated to the peptides. In some embodiments, for example, the simple carbon chains can render a conjugated peptide easily separable from unconjugated material. For example, methods that can be used to separate the desired peptide of the invention from unconjugated material can include, but is not limited to, solvent extraction and reverse phase chromatography. In some embodiments, a lipophilic moiety can be conjugated to the peptide and can extend half-life through reversible binding to serum albumin. Moreover, the conjugated moiety can be a lipophilic moiety that extends the half-life of the peptide through reversible binding to serum albumin. In some embodiments, the lipophilic moiety can be cholesterol or a cholesterol derivative including cholestenes, cholestanes, cholestadienes, and oxysterols. In some embodiments, a peptide can be conjugated to myristic acid (tetradecanoic acid) or a derivative thereof. In other embodiments, a peptide of the present disclosure can be coupled (e.g., conjugated) to a half-life modifying agent. Examples of half-life modifying agents can include but are not limited to: a polymer, a polyethylene glycol (PEG), a hydroxyethyl starch, polyvinyl alcohol, a water soluble polymer, a zwitterionic water soluble polymer, a water soluble poly(amino acid), a water soluble polymer of proline, alanine and serine, a water soluble polymer containing glycine, glutamic acid, and serine, an Fc region, a fatty acid, palmitic acid, antibodies, or a molecule that binds to albumin.

In some embodiments, the first two N-terminal amino acids (GS) of SEQ ID NO: 1-SEQ ID NO: 567, SEQ ID NO: 1243-SEQ ID NO: 1252, or SEQ ID NO: 1263-SEQ ID NO: 1289 can serve as a spacer or linker in order to facilitate conjugation or fusion to another molecule, as well as to facilitate cleavage of the peptide from such conjugated or fused molecules. In some embodiments, a peptide of the present disclosure can be conjugated to other moieties that, e.g., can modify or effect changes to the properties of the peptide.

Immuno-Oncology Agents ("I/Os")

The present disclosure provides immuno-oncology agents, referred to herein as "I/O" or "I/Os," to be complexed with peptides also disclosed herein for use in cancer therapy. An "I/O" or "I/O agent," as used herein, is nonlimiting and can comprise a single agent, multiple agents, or a complex of agents, with such agents being monomeric, dimer (e.g., homodimeric or heterodimeric), or multimeric (e.g., homomultimeric or heteromultimeric) in structure and with such agents singly, doubly, or multiply complexed, aggregated, modified, fused, linked, or in any combination of the foregoing. In some embodiments, I/Os of the present disclosure can promote anti-tumor host immune responses. For example, I/Os can promote anti-tumor host immune responses within a tumor microenvironment. Strategies that can be employed to achieve a robust immune response to a tumor can include, but are not limited to, induction of cytokine or chemokine secretion, upregulation of co-stimulatory molecules, activation and expansion of T cells (e.g., effector memory T cells), activation and expansion of natural killer (NK) cells, activation and expansion of dendritic cells (DCs) for antigen processing and presentation with suitable co-stimulatory signals, chemokines, and/or growth factors, inhibition of regulatory T cells (Tregs) and myeloid-derived suppressor cells, induction of immunogenic cell death (ICD) in tumor cells, activation of inflammasomes, induction of apoptosis, or a combination thereof. I/Os that can promote anti-tumor immunity via the above described strategies can include interferons (IFNs), cytokines from the interleukin (IL)-2, IL-12 and IL-1 families (e.g., IL-2, IL-15, IL-21, IL-12, IL-23, IL-27, IL-1, IL-18, IL-33), checkpoint inhibitors including, but not limited to, inhibitors of CTLA-4, PD-1, PD-L1, TIM-3, LAG-3, VISTA, TIGIT, B7-H3, B7-H4, B7S1, galectin 9, CD244, BTLA, CD160, CIS, LIGHT, TIGIT; ligands of pattern recognition receptors (PRRs) including, but not limited to, TLR, NLR, ALR, CLR, RLR, RIG-I, MDA5, and STING; molecules that inhibit the macrophage SIRPα-CD47 checkpoint, including but not limited agents that inhibit SIRPα, such as agents that downregulate CD47 expression at the cell surface of cancer cells, soluble SIRPα engineered to be a high-affinity competitive inhibitor, or other antagonists that directly bind to either SIRPα or CD47 and block their interaction and the SIRPα signal; molecules that inhibit the activity of the enzyme indoleamine-2,3-dioxygenase (IDO); molecules that block natural killer (NK) cell checkpoints including, but not limited to, KIR2DL1-3, KIR3DL1, and CD94/NKG2A; and ligands or other agonists or antagonists of TNF family members including, but not limited to, CD40, 4-1BB, OX40, ICOS, CD27, TL-1A, TRAIL, FAS, and GITR. Agonists or antagonists of the BCL2 family may be targeted, including but not limited to BCL2, Mcl-1, BCLXL, BFLa/A1, BCLW, Bax, Bak, Bok, Bad, Bik, Bid, Bim, Noxa, Puma, BMF and HRK. The Bcl-2 regulator FLIP is a possible target. In particular embodiments, the present disclosure provides combination treatment with the peptide-I/O complexes disclosed herein and any combination of PD-1 inhibitors or PD-L1 inhibitors or checkpoint inhibitors for treatment of cancer. Intracellular proteases may be targeted, including but not limited to caspases, cathepsins, calpains. In some embodiments, an I/O described in Burugu et al. (Semin Cancer Biol. 2017 Oct. 5. pii: S1044-579X(17)30182-70 is incorporated herein by reference. In some embodiments, the I/O can be a cytokine that can promote potent and effective anti-tumor immune responses, such as IL-15 and IL-12. In some embodiments, the I/O can be a PRR ligand, such as a RIG-I ligand, an MDA5 ligand, or a STING ligand. In some embodiments, the I/O can be a ligand of the TNF family, such as natural human 4-1BB ligand, OX40L, or CD40L. Delivery of these I/Os in a peptide-I/O complex can promote anti-tumor immunity, while reducing toxicity as compared to systemically administered free I/Os, thereby promoting an effective therapy for various cancers.

A. I/Os Comprising IL-15 Agents

An immuno-oncology agent (I/O) of the present disclosure can comprise an IL-15 agent. An IL-15 agent described herein can include any agent that bind to the IL-15 receptor. For example, IL-15 agents disclosed herein can include interleukin-15 (IL-15) itself, a fragment of IL-15, a variant of IL-15, a mutant of IL-15, such as IL-15N72D, any IL-15 receptor ligand, as well as fusions or complexes of such IL-15 molecules with all or a portion of the IL-15 receptor alpha chain such as IL-15/IL-15Rα fusions or complexes or IL-15/sushi+ domain fusions or complexes (e.g., a fusion of IL-15 or IL-15N72D and IL-15Rα or IL-15RαSu). The components of the IL-15 agent may be joined covalently, such as by a recombinant fusion or a chemical conjugate, or noncovalently, such as by a noncovalent high affinity association between IL-15 and all or a portion of the alpha receptor chain. In some embodiments, IL-15 can strongly induce NK cells, effector memory T cells, and γ/δ T cells in humans. In some embodiments, IL-15 can induce IFN-γ and granzyme, and can thereby increase cytotoxic activity. IL-15 can additionally inhibit ROR γt CD4+ T cells (Th17), does not stimulate activation-induced cell death (AICD), and can have little or no effect on Tregs (Waldmann, Cancer Immunol Res 3:219-227(2015)). IL-15 production can be regulated by cytokine-inducible SH2-containing (CIS) protein, a suppressor of cytokine signaling (SOCS) protein, and an NK checkpoint, as described by Delconte et al. (Nat Immunol. 2016 July; 17(7):816-24). IL-15 can induce tumor regression and/or inhibit or reduce metastasis and/or prevent or reduce tumor progression and/or increase survival in a subject, such as a human, non-human primate, or any other animal. IL-15 agents include Alt-803 (a novel IL-15 superagonist complex consisting of an IL-15 mutant (IL-15N72D) bound to an IL-15 receptor α/IgG1 Fc fusion protein) from Altor Bioscience (Margolin 2018, Wrangle 2018, Romee 2018), PEGylated forms of IL-15 and IL-2 (designed to not utilize the IL-2Rα chain that provides high affinity for IL-2, as in development by Nektar/BMS (NKTR-214, NCT03138889, NCT02983045) and Armo), ALKS4230 (Alkermes, NCT02799095), and heterodimeric IL-15 (hetIL15 by Admune/Novartis, NCT02452268). These early studies establish safe doses and meaningful pharmacodynamic responses to IL-15 agonist treatment. The potential for cancer therapy, as well as issues challenging IL-15 as such therapy, such as toxicity and short half-life, is reviewed in Robinson and Schluns, Immunol Lett 190:159-168 (2017)). The efficacy and safety of cancer therapy by IL-15 agents can be increased by targeting an IL-15 agents to a tumor, by reducing IL-15 agent activity prior to tumor cell processing, or by trafficking and presentation of the IL-15 agent by tumor cells, such as by the peptide-I/O complexes of this disclosure.

The immune cell subsets that are influenced by IL-15 agents may have the ability to eradicate tumors. An IL-15 agent can have effects on multiple cell types, including important differences from IL-2. An IL-15 agent can comprise a fusion with the IL-15Rα and this fusion can have a significantly greater potency and a longer in vivo circulation time than a naked IL-15 agent.

In some embodiments of the peptide-I/O complexes, the peptide-I/O complex is a peptide-IL-15 agent complex (such complex herein also referred to as IL-15 I/O). The IL-15 agent of such peptide-IL-15 agent complexes can comprise an IL-15 or IL-15 fragment. Further the IL-15 agent of such peptide-IL-15 agent complex of can be a fusion of IL-15 with IL-15Rα (IL-15Rα being the alpha receptor chain for IL-15 receptor). Thus the peptide-I/O complex can comprise at least a heterodimeric fusion of IL-15/IL-15Rα, which can bind or interact with the IL-15Rβ/γ receptor to achieve a desired biological effect, such as inducing, activating, or enhancing biological activity on the IL-15Rβ/γ, or reducing, blocking or inhibiting the activity thereon. In some embodiments, the IL-15 agent portion of the peptide-IL-15 agent complex is a fusion comprising at least one IL-15 agent with at least one subunit of its receptor, e.g., IL-15Rα). In other aspects, it is understood that the IL-15 agent is a fusion comprising at least one fragment of an IL-15 with at least one fragment of its receptor subunit, e.g., a fragment of IL-15Rα. Such fragments of the IL-15Rα portion of the IL-15 agent can include, for example, the exon-2 domain of IL-15Rα is also referred to as the sushi domain, or the exon-3 domain comprising a 13 amino acid peptide at its N-terminus, or sushi domain plus the 13 amino acid peptide from exon-3, amongst others described herein. Such complexes and fragments bind or interact with the IL-15Rβ/γ in a manner that induces, activates, or enhances biological activity on the IL-15Rβ/γ, or reduces, blocks or inhibits the activity thereon. In addition either the IL-15 itself or in combination with IL-15Rα in the IL-15 agent can have mutations as described herein. The IL-15β/γ receptor can be expressed on the surface of T cells and NK cells, such as in humans or non-human primates.

This IL-15β/γ receptor can comprise the common subunits of the IL-2 and IL-15 receptors and can have low to intermediate affinity for the IL-15 agent. The high-affinity receptors for IL-2 and IL-15 agents can also each comprise a third a chain that is cytokine specific and enhances affinity for cytokine binding. In some embodiments, an IL-15 agent can be fused or complexed noncovalently at the cell surface with the full length IL-15Rα. In some embodiments, IL-15 agent is fused or complexed noncovalently with IL-15Rα prior to administration. The combination of an IL-15 agent with an IL-15Rα or portion thereof can act as a superagonist and can demonstrate higher potency than IL-15 alone. In other embodiments, an IL-15 agent can circulate complexed with the soluble form of IL-15Rα after administration. In some embodiments, IL-15βγ can be activated by the IL-15/IL-15Rα fusion, as described by Mortier et al. (J Biol Chem. 2006 Jan. 20; 281(3):1612-9). In some embodiments, the exon-2 domain of IL-15Rα is also referred to as the sushi domain, and can be important for fusion to IL-15 itself, and the exon-3 domain comprising a 13 amino acid peptide at its N-terminus can be important to stabilize the IL-15/IL-15Rα fusion. The sushi domain plus the 13 amino acid peptide from exon-3 can also be referred to as IL-15Rα "sushi+" or "sushi plus," which is described by Bouchaud et al. (J Mol Biol. 2008 Sep. 26; 382(1):1-12). The sequence of IL-15Rα "IL-15Ra sushi+" is ITCPPPMSVEHADIWVKSYSLYSR-ERYICNSGFKRKAGTSSLTECVLNKATNVAHWTTPS LKCIRDPALVHQRPAPP (SEQ ID NO: 1176). In some embodiments, the IL-15 agent can be a fusion of IL-15 or IL-15N72D with IL-15Ra sushi+. In some embodiments, the IL-15 fusion with IL-15Ra sushi+ can comprise any one of the sequences set forth in SEQ ID NO: 1135-SEQ ID NO: 1138, SEQ ID NO: 1176-SEQ ID NO: 1179, or SEQ ID NO: 1342, and all sequences set forth in TABLE 3.

In some embodiments, the IL-15 agent of the present invention can be a soluble complex (IL-15N72D:IL-15RαSu/Fc) comprising IL-15 N72D and a dimeric IL-15Rα sushi domain-IgG1 Fc fusion protein, which is an IL-15 N72D mutant complexed through a noncovalent high affinity interaction with IL-15RαSu fused to an Fc domain. In some embodiments, the IL-15 agent can comprise a complex comprising SEQ ID NO: 1179 (ITCPPPMSVE-HADIWVKSYSLYSRERYICNSGFKRKAGTSSLTE-CVINKATNVAHW TTPSLKCIREPKSCDKTHTCPPC-PAPELLGGPSVFLFPPKPKDTLMISRTPEVTCVVVDVS HEDPEVKFNWYVDGVEVHNAKTKPREEQYN-STYRVVSVLTVLHQDWLNGKEYKCKV SNKALPA-PIEKTISKAKGQPREPQVYTLPPSRDELTKNQVSLT-CLVKGFYPSDIAVEWES NGQPENNYKTTPPVLDS-DGSFFLYSKLTVDKSRWQQGNVFSCSVMHEALHN-HYTQKSL SLSPGK, IL-15RαSu fused to an Fc domain, IL-15RαSu/Fc fusion, bolded section depicts IL-15RαSu and non-bolded section shows IgG1 CH2-CH3 (Fc domain)), SEQ ID NO: 1179 (IL-15RαSu fused to an Fc domain), SEQ ID NO: 1178 (NWVNVISDLK-KIEDLIQSMHIDATLYTESDVHPSCKVTAMKCFL-LELQVISLESGDASIH DTVENLIILANDSLSSNG-NVTESGCKECEELEEKNIKEFLQSFVHIVQMFINTS, IL-15 N72D mutant), and SEQ ID NO: 1178 (IL-15 N72D mutant). In other words, two moieties of SEQ ID NO: 1179 are complexed with two moieties of SEQ ID NO: 1178 to form the IL-15 I/O. In some embodiments, the IL-15 agent can comprise a complex comprising SEQ ID NO: 1179 (IL-15RαSu fused to an Fc domain), SEQ ID NO: 1179 (IL-15RαSu fused to an Fc domain), SEQ ID NO: 1177 (IL-15), and SEQ ID NO: 1177 (NWVNVISDLK-KIEDLIQSMHIDATLYTESDVHPSCKVTAMKCFL-LELQVISLESGDASIH DTVENLIILANNSLSSNG-NVTESGCKECEELEEKNIKEFLQSFVHIVQMFINTS, IL-15). In other words, two moieties of SEQ ID NO: 1179 are complexed with two moieties of SEQ ID NO: 1177 to form the IL-15 agent.

In some embodiments, the IL-15 agent can be $L_0$-X-$L_1$-Y-$L_2$, wherein one of X or Y can be any one SEQ ID NO: 1177 or SEQ ID NO: 1178 and one of X or Y can be SEQ ID NO: 1179 or SEQ ID NO: 1176. Furthermore, $L_0$, $L_1$, and $L_2$ can comprise any of SEQ ID NO: 1163-SEQ ID NO: 1172, SEQ ID NO: 1139-SEQ ID NO: 1161, or SEQ ID NO: 1359-SEQ ID NO: 1366, or can be Xn, where X is any amino acid and n=1-50 or can be absent. In some embodiments, the IL-15 agent can be a complex of two moieties of SEQ ID NO: 1177 and of SEQ ID NO: 1179. In other embodiments, the IL-15 agent can be a complex of two moieties of SEQ ID NO: 1178 and of SEQ ID NO: 1179. For instance, the IL-15 agent can be $L_0$-X-$L_1$-Y-$L_2$, wherein $L_1$ can be SEQ ID NO: 1169 or SEQ ID NO: 1163, X can be SEQ ID NO: 1176 or SEQ ID NO: 1179, and Y can be SEQ ID NO: 1177, SEQ ID NO: 1178, in any combination. In addition, peptide-IL-15 agent complexes can comprise any of the complexes of TABLE 4.

In some embodiments, the IL-15 (NWVNVISDLK-KIEDLIQSMHIDATLYTESDVHPSCKVTAMKCFL-LELQVISLESGDASIH DTVENLIILANNSLSSNG-NVTESGCKECEELEEKNIKEFLQSFVHIVQMFINTS; SEQ ID NO: 1177) part of the IL15 agent can have one or more of the following mutations: L45D (Bernard et al. J Biol Chem. 2004 Jun. 4; 279(23):24313-22), L45E (Bernard et al. J Biol Chem. 2004 Jun. 4; 279(23):24313-22), Q48K (Bernard et al. J Biol Chem. 2004 Jun. 4; 279(23):24313-22), V49D (Bernard et al. J Biol Chem. 2004 Jun. 4; 279(23): 24313-22), S51D (Bernard et al. J Biol Chem. 2004 Jun. 4; 279(23):24313-22), L52D (Bernard et al. J Biol Chem. 2004 Jun. 4; 279(23):24313-22), N72D (Zhu 2009 and U.S. Ser. No. 00/816,3879), N72E (Zhu 2009), N72A (Zhu 2009), N72S (Zhu 2009), N72Y (Zhu 2009), N72R (U.S. Ser. No. 00/816,3879), D61A (U.S. Ser. No. 00/816,3879), or any combination thereof. In some embodiments, any one or more than one of the mutations described above can be present in a mutant form of IL-15, or incorporated into SEQ ID NO: 1135-SEQ ID NO: 1138 with numbering appropriate to the IL-15 portion as follows: N72D, L45D, L45E, Q48K, V49D, S51D, L52D, N72E, N72A, N72S, N72Y, N72R, or D61A. It is understood that any combination or number of such mutations can be present in the IL-15 variant or incorporated into SEQ ID NO: 1135-SEQ ID NO: 1138.

In some embodiments, complexes of a peptide of the present disclosure and an I/O, wherein the I/O is ALT-803, can lead to enhanced intracellular uptake or intratumoral concentration and therapeutic efficacy, including long-term survival and a potent antitumor immune response to a tumor. ALT-803 and IL-15 agent and is described in US20140134128 and Han et al. (Cytokine. 2011 December; 56(3):804-10), which is incorporated herein by reference. The peptide can optionally be fused to the IL-15 N72D portion of the molecule, the IL-15RαSu-Fc portion of the molecule, or any combination thereof, with a cleavable linker or a stable linker. In some embodiments, complexes of a peptide of the present disclosure and an I/O, wherein the I/O is IL-15Rα/IL-15Fc, can lead to enhanced intracellular uptake or intratumoral concentration and therapeutic efficacy, including anti-tumor activity against the tumor. The tumor can be any type of tumor as described herein, such as glioblastoma and melanoma.

In some embodiments, the IL-15 agent can comprise any IL-15 agent sequence or any fragment or variant thereof that retains function and activity. That is, an IL-15 agent of the present disclosure can be a truncated and/or mutated IL-15 agent, which is still capable of binding the IL-15 receptor and stimulating downstream cellular responses. In some embodiments, the IL-15 agent can comprise a sequence of (SEQ ID NO: 1491)
NWVNVISDLKKIEDLIQSMHIDATLYTESDVHPSCKVTAMKCFLLELQVIS

LESGDASIHDTVENLIILANNSLSSNGNVTESGCKECEELEEKNIKEFLQS

FVHIVQMFIN.

In some embodiments, a peptide of the present disclosure can be fused to an IL-15 hyperagonist as shown in SEQ ID NO: 1233 (MAPRRARGCRTLGLPALLLLLLRP-PATRGDYKDDDDKIEGRITCPPPMSVEHADIWVK SYSLYSRERYICNSGFKRKAGTSSLTECVLNKATN-VAHWTTPSLKCIRDPALVHQRPAPP GGSGGGGSG-GGSGGGGSLQNWVNVISDLKKIEDLIQSMHIDAT-LYTESDVHPSCKVTA MKCFLLELQVISLESG-DASIHDTVENLIILANNSLSSNGNVTESGCKECEELE- EKNIKEFL QSFVHIVQMFINTS$X_1X_2X_3X_4X_5X_6X_7X_8X_9X_{10}X_{11}X_{12}X_{13}X_{14}X_{15}X_{16}X_{17}X_{18}X_{19}X_{20}X_{21}X_{22}X_{23}X_{24}X_{25}X_{26}X_{27}X_{28}X_{29}X_{30}X_{31}X_{32}X_{33}X_{34}X_{35}X_{36}X_{37}X_{38}X_{39}X_{40}X_{41}X_{42}X_{43}X_{44}X_{45}X_{46}X_{47}X_{48}X_{49}X_{50}$MCM PCFTTDHQMARKCDDCCGGKGRGKCYGPQCLCR) or SEQ ID NO: 1234 (MAPRRARGCRTLGL-PALLLLLLLRPPATRGDYKDDDDKIEGRNWVNVIS-DLKKIEDLIQ SMHIDATLYTESDVHPSCKVTAMK-CFLLELQVISLESGDASIHDTVENLIILANNSLSSNG NVTESGCKECEELEEKNIKEFLQSFVHIVQMFINT-SSGGGSGGGGSGGGGSGGGGSGGG SLQITCPPPMS-VEHADIWVKSYSLYSRERYICNSGFKRKAGTSSLT-ECVLNKATNVAHW TTPSLKCIRDPALVHQRPAPP $X_1X_2X_3X_4X_5X_6X_7X_8X_9X_{10}X_{11}X_{12}X_{13}X_{14}X_{15}X_{16}X_{17}X_{18}X_{19}X_{20}X_{21}X_{22}X_{23}X_{24}X_{25}X_{26}X_{27}X_{28}X_{29}X_{30}X_{31}X_{32}X_{33}X_{34}X_{35}X_{36}X_{37}X_{38}X_{39}X_{40}X_{41}X_{42}X_{43}X_{44}X_{45}X_{46}X_{47}X_{48}X_{49}X_{50}$MCIVIPCFTTDMMARK CDDCCGGKGR-GKCYGPQCLCR), ITCPPPMSVEHADIWVKSYSLYSR-ERYICNSGFKRKAGTSSLTECVLNKATNVAHWTTPS LKCIRDPALVHQRPAPPSGGSGGGGSGGGSGGGGS-LQNWVNVISDLKKIEDLIQSMHID ATLYTESDVHP-SCKVTAMKCFLLELQVISLESGDASIHDTVEN-LIILANNSLSSNGNVTES GCKECEELEEKNIKEF-LQSFVHIVQMFINTS$X_1X_2X_3X_4X_5X_6X_7X_8X_9X_{10}X_{11}X_{12}X_{13}X_{14}X_{15}X_{16}X_{17}X_{18}X_{19}X_{20}X_{21}X_{22}X_{23}X_{24}X_{25}X_{26}X_{27}X_{28}X_{29}X_{30}X_{31}X_{32}X_{33}X_{34}X_{35}X_{36}X_{37}X_{38}X_{39}X_{40}X_{41}X_{42}X_{43}X_{44}X_{45}X_{46}X_{47}X_{48}X_{49}X_{50}$MCMPCFTTDHQMAR-KCDDCCGGKGRGKCYGPQCLCR (SEQ ID NO: 1349), or NWVNVISDLKKIEDLIQSMHIDATLYTESDVHP-SCKVTAMKCFLLELQVISLESGDASIH DTVEN-LIILANNSLSSNGNVTESGCKECEELEEKNIKE-FLQSFVHIVQMFINTSSGGGSGG GGSGGGGSGG-GGSGGGSLQITCPPPMSVEHADIWVKSYSLYSR-ERYICNSGFKRKAGTS SLTECVLNKATNVAHWTTP-SLKCIRDPALVHQRPAPP$X_1X_2X_3X_4X_5X_6X_7X_8X_9X_{10}X_{11}X_{12}X_{13}X_{14}X_{15}X_{16}X_{17}X_{18}X_{19}X_{20}X_{21}X_{22}X_{23}X_{24}X_{25}X_{26}X_{27}X_{28}X_{29}X_{30}X_{31}X_{32}X_{33}X_{34}X_{35}X_{36}X_{37}X_{38}X_{39}X_{40}X_{41}X_{42}X_{43}X_{44}X_{45}X_{46}X_{47}X_{48}X_{49}X_{50}$MCMPCFTTDHQ-MARKCDDCCGGKGRGKCYGPQCLCR (SEQ ID NO: 1350), and can lead to enhanced intracellular uptake or intratumoral concentration and therapeutic efficacy, including long-term survival and a potent antitumor immune response to a tumor. Any one of $X_1$, $X_2$, $X_3$, $X_4$, $X_5$, $X_6$, $X_7$, $X_8$, $X_9$, $X_{10}$, $X_{11}$, $X_{12}$, $X_{13}$, $X_{14}$, $X_{15}$, $X_{16}$, $X_{17}$, $X_{18}$, $X_{19}$, $X_{20}$, $X_{21}$, $X_{22}$, $X_{23}$, $X_{24}$, $X_{25}$, $X_{26}$, $X_{27}$, $X_{28}$, $X_{29}$, $X_{30}$, $X_{31}$, $X_{32}$, $X_{33}$, $X_{34}$, $X_{35}$, $X_{36}$, $X_{37}$, $X_{38}$, $X_{39}$, $X_{40}$, $X_{41}$, $X_{42}$, $X_{43}$, $X_{44}$, $X_{45}$, $X_{46}$, $X_{47}$, $X_{48}$, $X_{49}$, and $X_{50}$ in SEQ ID NO: 1233, SEQ ID NO: 1234, or SEQ ID NO: 1349, or SEQ ID NO: 1350 can each individually be any amino acid residue or can be absent. In some embodiments, any one of $X_1$, $X_2$, $X_3$, $X_4$, $X_5$, $X_6$, $X_7$, $X_8$, $X_9$, $X_{10}$, $X_{11}$, $X_{12}$, $X_{13}$, $X_{14}$, $X_{15}$, $X_{16}$, $X_{17}$, $X_{18}$, $X_{19}$, $X_{20}$, $X_{21}$, $X_{22}$, $X_{23}$, $X_{24}$, $X_{25}$, $X_{26}$, $X_{27}$, $X_{28}$, $X_{29}$, $X_{30}$, $X_{31}$, $X_{32}$, $X_{33}$, $X_{34}$, $X_{35}$, $X_{36}$, $X_{37}$, $X_{38}$, $X_{39}$, $X_{40}$, $X_{41}$, $X_{42}$, $X_{43}$, $X_{44}$, $X_{45}$, $X_{46}$, $X_{47}$, $X_{48}$, $X_{49}$, and $X_{50}$ can comprise any cleavable linker of the present disclosure, such as any one of SEQ ID NO: 1139-SEQ ID NO: 1161, SEQ ID NO: 1360-SEQ ID NO: 1363, or SEQ ID NO: 1365. In some embodiments, any one of $X_1$, $X_2$, $X_3$, $X_4$, $X_5$, $X_6$, $X_7$, $X_8$, $X_9$, $X_{10}$, $X_{11}$, $X_{12}$, $X_{13}$, $X_{14}$, $X_{15}$, $X_{16}$, $X_{17}$, $X_{18}$, $X_{19}$, $X_{20}$, $X_{21}$, $X_{22}$, $X_{23}$, $X_{24}$, $X_{25}$, $X_{26}$, $X_{27}$, $X_{28}$, $X_{29}$, $X_{30}$, $X_{31}$, $X_{32}$, $X_{33}$, $X_{34}$, $X_{35}$, $X_{36}$, $X_{37}$, $X_{38}$, $X_{39}$, $X_{40}$, $X_{41}$, $X_{42}$, $X_{43}$, $X_{44}$, $X_{45}$, $X_{46}$, $X_{47}$, $X_{48}$, $X_{49}$, and $X_{50}$ can comprise a stable linker, such as any one of SEQ ID NO: 1163-SEQ ID NO: 1172 or any one of SEQ ID NO: 1359, SEQ ID NO: 1364, SEQ ID NO: 1366, and can optionally further comprise a cleavable linker. Said fusions can be preceded by a signal peptide, an exemplary sequence of which is shown in SEQ ID NO: 1232 (MAPRRARGCRTLGLPALLLLLLLRPPATRG) or an IgG kappa leader sequence (METDTLLLWVLLLWVPGSTG; SEQ ID NO: 1367) and can also be preceded or followed by a purification tag, such as FLAG-Xa (DYKDDDDKIEGR), as shown in SEQ ID NO: 1162 or a His tag, such as $His_x$ where x=1-20 (SEQ ID NO: 1368). SEQ ID NO: 1233 and SEQ ID NO: 1234 are shown in FIG. 3 and FIG. 4, respectively. X in FIG. 3 and FIG. 4 represents $X_1X_2X_3X_4X_5X_6X_7X_8X_9X_{10}X_{11}X_{12}X_{13}X_{14}X_{15}X_{16}X_{17}X_{18}X_{19}X_{20}X_{21}X_{22}X_{23}X_{24}X_{25}X_{26}X_{27}X_{28}X_{29}X_{30}X_{31}X_{32}X_{33}X_{34}X_{35}X_{36}X_{37}X_{38}X_{39}X_{40}X_{41}X_{42}X_{43}X_{44}X_{45}X_{46}X_{47}X_{48}X_{49}X_{50}$.

Because IL-15 is active extracellularly in tumors, the present disclosure can provide a peptide-I/O complex comprising a peptide-IL-15 agent complex in which the peptide can home, distribute to, target, migrate to, be processed by, or accumulate in the tumor microenvironment. Subsequently, the peptide can mediate cell penetration, allowing for intracellular processing to release IL-15 optionally from the peptide-I/O complex at a higher local concentration or with a higher bioactivity or at the cell surface, or the peptide can mediate tumor penetration, and/or extracellular delivery of IL-15 in the tumor microenvironment. In some embodiments, the peptide-IL-15 agent complex can comprise an IL-15 agent that is chemically conjugated or recombinantly expressed as a fusion with a peptide of this disclosure. In these cases, the peptide and IL-15 agent can optionally be linked with a cleavable linker, such that the linker can be cleaved selectively in the tumor microenvironment or in the tumor cells and thereby releases IL-15 in high concentrations and/or at a higher potency after cleavage. Alternatively, the peptide and IL-15 agent can be linked with a stable linker and can be active as a peptide-IL-15 agent complex, or the linker can be cleaved by catabolism. In some embodiments, the peptide and I/O may be cleaved, dissociated, degraded, processed as additionally described herein. In some embodiments, the IL-15 agent can access intracellular compartments, such as the endosome, lysosome, endoplasmic reticulum, or Golgi apparatus due to the cell penetrating properties of the peptide. In such cases, the linker can be acid labile and can be cleaved in the acidic environment of the endosome or can be enzymatically cleavable or can be cleaved by reduction. This can be followed by cytokine recycling to the cell surface, at which location cleavage can optionally occur. In other embodiments, the peptide-IL-15 agent complex is co-formulated. In some embodiments, the peptide-IL-15 agent complex is formulated in a delivery vehicle, such as a liposome. For example, liposome particles can be coated with a peptide of the present disclosure and can additionally formulate IL-15. Particulate vehicles can have enhanced cellular uptake into intracellular compartments, thereby allowing for greater concentrations of IL-15 to access cytokine recycling pathways. In other embodiments, an IL-15 mRNA agent can be encapsulated in a liposome, which can be further coated with a peptide of the present disclosure. In other embodiments, an IL-15 agent can be encoded for by an expression vector. DNA can be encapsulated in a liposome, which can be further coated with a peptide of the present disclosure. For this, a promoter can be used in the expression vector such that the IL-15 agent is only actively expressed once in cancer cells. In some embodiments, any one of the IL-15 agents shown below in TABLE 3 can be an I/O complexed with any peptide of the present disclosure. Other IL-15 agents that can be used as an I/O in the present application include those described in Chertova et al. (J Biol Chem. 2013 June; 288(25): 18093-103), Ochoa et al. (Cancer Res. 2012; 73(1):139-149), Bouchaud et al. (J Mol Biol.

2008; 283: 1-12), Kermer et al. (Mol Cancer Ther. 2012 June; 11(6):1279-1288), Kermer et al. (Mol Cancer Ther. 2014 January; 13(1): 112-121), Dubois et al. (J Immunol. 2008; 180: 2099-2106), Cheng et al. (OncoImmunology. 2014 November; 3(11): e963409), Stone et al. (Biotechnol Prog. 2012 November; 28(6):1588-1597), Wong et al. (Protectin Engineering, Design, & Selection. 2011; 24(4):373-383), Wu and Xu. (Journal of Molecular Cell Biology. 2010; 2:217-222), all of which are incorporated herein in their entirety by reference.

The peptide-IL-15 agent complex can be a peptide fusion designed, as a prodrug, to be significantly less potent than the IL-15 agent alone in order to minimize toxicity. The uptake and processing of this peptide-IL-15 agent complex by tumor target cells can result in the removal of the peptide from the peptide-IL-15 agent complex, and can result in the restoration of higher or full potency of the IL-15 agent. This prodrug configuration can enable administration of higher doses of the IL-15 agent than otherwise possible. The combination of tumor targeting and prodrug configuration of the peptide-IL-15 agent complexes can improve the therapeutic efficacy of IL-15 therapy.

Prodrug cleavage and release of fully potent IL-15 agent from the peptide-IL-15 agent complex can also take place at the cell surface and/or in the tumor microenvironment due to surface expressed or secreted enzymes. This process may release higher levels of drug in the tumor compared with the circulation, enabling administration of effective doses with less systemic toxicity.

In some cases, the peptide-IL-15 agent complex may only be modified after review for potential ligand/receptor interaction. For example the region including D8 of an IL-15 agent interacts with the IL-2/15 receptor beta chain and this interaction may be preserved for a fully functioning ligand/receptor complex. Similarly, PEGylation of the two freely accessible lysines, K10 and K11, results in an IL-15 agent that may be unable to signal because of the disrupted interaction with the IL-2/15 receptor beta chain. The region of an IL-15 agent including Q108 can interact with the common gamma receptor chain and may be preserved for a fully functioning ligand/receptor complex (Pettit et. al 1997). O- and/or N-linked glycosylation of an IL-15 agent may not be required for active signaling or ligand/receptor interaction because the IL-15 agent may be produced from E. coli-based production systems, which may be incapable of producing O- or N-linked glycosylated proteins, and can be active in biological assays. Thus, IL-15 itself may or may not be glycosylated and may be produced in cells that do not glycosylate, such as E. coli, or cells that do glycosylate, such as CHO, pichia, or HEK cells.

In some embodiments, the IL-15 agent is a complex comprising two polypeptides having a sequence of SEQ ID NO: 1179 associated with a polypeptide having a sequence of SEQ ID NO: 1177 (native IL-15). In particular embodiments, this IL-15 agent comprises a complex, wherein the two polypeptides of SEQ ID NO: 1179 are covalently linked by a disulfide linkage and are further non-covalently associated through high affinity bonding between each of SEQ ID NO: 1179 and SEQ ID NO: 1177.

In some embodiments, the IL-15 agent comprises a complex of two polypeptides having a sequence of SEQ ID NO: 1179 associated with two polypeptides having a sequence of SEQ ID NO: 1178 (N72D mutant of IL-15. In particular embodiments, this IL-15 agent comprises a complex, wherein the two polypeptides of SEQ ID NO: 1179 are covalently linked by a disulfide linkage and are further non-covalently associated through high affinity binding between each of SEQ ID NO: 1179 and SEQ ID NO: 1178.

As used herein "RLI" or "ILR" is used as an abbreviation used to described an I/O that is a IL-15 agent comprising a complex of polynucleotides or peptides that link an IL-15 "receptor" (meaning any of the IL-15 receptor variants or fragments as described herein) with an IL-15R "ligand" (meaning any of the IL-15 variants or fragments described herein), in any combination of the foregoing, and any fragments thereof.

TABLE 3

IL-15 Agent Sequences

| SEQ ID NO (if applicable) | IL-15 Agent Sequences | Description |
| --- | --- | --- |
| SEQ ID NO: 1135 | ITCPPPMSVEHADIWVKSYSLYSRERYI CNSGFKRKAGTSSLTECVLNKATNVA HWTTPSLKCIRDPALVHQRPAPPGGSG GGGSGGGSGGGGSL*QNWVNVISDLKKIE DLIQSMHIDATLYTESDVHPSCKVTAMKCF LLELQVISLESGDASIHDTVENLIILANNSLSS NGNVTESGCKECEELEEKNIKEFLQSFVHI VQMFINTS* | IL-15Rα, a linker, and IL-15 (referred to as an exemplary "RLI" from the N to C-terminus direction). IL-15Rα sushi+ is bolded and IL-15 is italicized. |
| SEQ ID NO: 1136 | *NWVNVISDLKKIEDLIQSMHIDATLYTESDV HPSCKVTAMKCFLLELQVISLESGDASIHD TVENLIILANNSLSSNGNVTESGCKECEELE EKNIKEFLQSFVHIVQMFINTS*SGGGSGGG GSGGGGSGGGGSGGGSLQITCPPPMSV EHADIWVKSYSLYSRERYICNSGFKRK AGTSSLTECVLNKATNVAHWTTPSLK CIRDPALVHQRPAPP | IL-15, a linker, and IL-15Ra (referred to as an exemplary "ILR" from the N to C-terminus direction). IL-15Rα sushi+ is bolded and IL-15 is italicized. |
| SEQ ID NO: 1137 | ITCPPPMSVEHADIWVKSYSLYSRERYI CNSGFKRKAGTSSLTECVLNKATNVA HWTTPSLKCIRDPALVHQRPAPPGGSG GGGSGGGSGGGGSL*QNWVNVISDLKKIE DLIQSMHIDATLYTESDVHPSCKVTAMKCF LLELQVISLESGDASIHDTVENLIILANDSLS SNGNVTESGCKECEELEEKNIKEFLQSFVH IVQMFINTS* | An RLI with N72D mutation. IL-15Ra, a linker, and IL-15 (referred to as "RLI" from the N to C-terminus direction). IL-15Ra sushi+ sequence is bolded. IL-15 sequence is italicized |

TABLE 3-continued

IL-15 Agent Sequences

| SEQ ID NO (if applicable) | IL-15 Agent Sequences | Description |
|---|---|---|
| SEQ ID NO: 1138 | NWVNVISDLKKIEDLIQSMHIDATLYTESDV HPSCKVTAMKCFLLELQVISLESGDASIHD TVENLIILANDSLSSNGNVTESGCKECEELE EKNIKEFLQSFVHIVQMFINTSSGGGSGGG GSGGGGSGGGGSGGGSLQITCPPPMSV EHADIWVKSYSLYSRERYICNSGFKRK AGTSSLTECVLNKATNVAHWTTPSLK CIRDPALVHQRPAPP | An ILR with N72D mutation. IL-15, a linker, and IL-15Ra (referred to as "ILR" from the N to C-terminus direction). IL-15Ra sushi+ sequence is bolded. IL-15 sequence is italicized |
| SEQ ID NO: 1177 | NWVNVISDLKKIEDLIQSMHIDATLYTES DVHPSCKVTAMKCFLLELQVISLESGDA SIHDTVENLIILANNSLSSNGNVTESGCK ECEELEEKNIKEFLQSFVHIVQMFINTS | Mature, secreted form of IL-15 |
| SEQ ID NO: 1178 | NWVNVISDLKKIEDLIQSMHIDATLYTES DVHPSCKVTAMKCFLLELQVISLESGDA SIHDTVENLIILANDSLSSNGNVTESGCK ECEELEEKNIKEFLQSFVHIVQMFINTS | N72D form of IL-15 |
|  | Two polypeptides having a sequence of SEQ ID NO: 1179 associated with two polypeptides having a sequence of SEQ ID NO: 1177 | Complex using native IL-15 |
|  | Two polypeptides having a sequence of SEQ ID NO: 1179 associated with two polypeptides having a sequence of SEQ ID NO: 1178 | Complex using N72D IL-15 |
| SEQ ID NO: 1491 | NWVNVISDLKKIEDLIQSMHIDATLYTES DVHPSCKVTAMKCFLLELQVISLESGDA SIHDTVENLIILANNSLSSNGNVTESGCK ECEELEEKNIKEFLQSFVHIVQMFIN | Minimal form of IL-15 |
| SEQ ID NO: 1342 | HHHHHHHHHH<u>ITCPPPMSVEHADIWV KSYSLYSRERYICNSGFKRKAGTSSLTEC VLNKATNVAHWTTPSLKCIRDPALVHQ RPAPP</u>*SGGSGGGGSGGGSGGGGSLQ*<u>NWV NVISDLKKIEDLIQSMHIDATLYTESDV HPSCKVTAMKCFLLELQVISLESGDAS IHDTVENLIILANNSLSSNGNVTESGCK ECEELEEKNIKEFLQSFVHIVQMFINTS</u> | A His-tagged RLI; His tag is shown in bold, the sushi domain is shown in underlining, the IL-15 agent linker is shown in italics, the IL-15 agent is shown in bold and underlining |
| SEQ ID NO: 1176 | ITCPPPMSVEHADIWVKSYSLYSRERYIC NSGFKRKAGTSSLTECVLNKATNVAHW TTPSLKCIRDPALVHQRPAPP | IL-15 sushi+; Sushi domain encoded by Exon 2 plus the N terminal 13 aa encoded by Exon 3 (Bouchard 2008) |
| SEQ ID NO: 1432 | ITCPPPMSVEHADIWVKSYSLYSRERYICNSG FKRKAGTSSLTECVLNKATNVAHWTTPSLK CIRDPALVHQRPAPPEPKSCDKTHTCPPCPAP ELLGGPSVFLFPPKPKDTLMISRTPEVTCVVV DVSHEDPEVKFNWYVDGVEVHNAKTKPRE EQYNSTYRVVSVLTVLHQDWLNGKEYKCK VSNKALPAPIEKTISKAKGQPREPQVYTLPPS RDELTKNQVSLTCLVKGFYPSDIAVEWESNG QPENNYKTTPPVLDSDGSFFLYSKLTVDKSR WQQGNVFSCSVMHEALHNHYTQKSLSLSPG K | IL-15Ra Sushi+ followed by IgG1 hinge and CH2 + CH3 regions (Fc) |
|  | Two polypeptides having a sequence of SEQ ID NO: 1432 associated with two polypeptides having a sequence of SEQ ID NO: 1177 | |
|  | Two polypeptides having a sequence of SEQ ID NO: 1432 associated with two polypeptides having a sequence of SEQ ID NO: 1178 | |

TABLE 3-continued

IL-15 Agent Sequences

| SEQ ID NO (if applicable) | IL-15 Agent Sequences | Description |
|---|---|---|
| SEQ ID NO: 1433 | ITCPPPMSVEHADIWVKSYSLYSRERYICNSG FKRKAGTSSLTECVLNKATNVAHWTTPSLK CIRDPALVHQRPAPPSTVTTAGVTPQPESLSP SGKEPAASSPSSNNTAATTAAIVPGSQLMPS KSPSTGTTEISSHESSHGTPSQTTAKNWELTA SASHQPPGVYPQGHSDTTEPKSCDKTHTCPP CPAPELLGGPSVFLFPPKPKDTLMISRTPEVT CVVVDVSHEDPEVKFNWYVDGVEVHNAKT KPREEQYNSTYRVVSVLTVLHQDWLNGKEY KCKVSNKALPAPIEKTISKAKGQPREPQVYT LPPSRDELTKNQVSLTCLVKGFYPSDIAVEW ESNGQPENNYKTTPPVLDSDGSFFLYSKLTV DKSRWQQGNVFSCSVMHEALHNHYTQKSL SLSPGK<br><br>Two polypeptides having a sequence of SEQ ID NO: 1433 associated with two polypeptides having a sequence of SEQ ID NO: 1177<br><br>Two polypeptides having a sequence of SEQ ID NO: 1433 associated with two polypeptides having a sequence of SEQ ID NO: 1178 | Complete IL-15Ra followed by IgG1 hinge and CH2 + CH3 regions (Fc) |
| SEQ ID NO: 1501 | ITCPPPMSVEHADIWVKSYSLYSRERYIC NSGFKRKAGTSSLTECVLNKATNVAHW TTPSLKCIRDPALVHQRPAPPSGGSGGGG SGGGSGGGGSLQNWVNVISDLKKIEDLI QSMHIDATLYTESDVHPSCKVTAMKCFL LELQVISLESGDASIHDTVENLIILANNSL SSNGNVTESGCKECEELEEKNIKEFLQSF VHIVQMFINTS | An RLI, containing SEQ ID NO: 1176, SEQ ID NO: 1177, and SEQ ID NO: 1169 |
| SEQ ID NO: 1502 | <u>ITCPPPMSVEHADIWVKSYSLYSRERYIC</u><br><u>NSGFKRKAGTSSLTECVLNKATNVAHW</u><br><u>TTPSLKCIRDPALVHQRPAPPSGGSGGGG</u><br>SGGGSGGGGSLQ*NWVNVISDLKKIEDLIQS*<br>*MHIDATLYTESDVHPSCKVTAMKCFLLELQ*<br>*VISLESGDASIHDTVENLIILANDSLSSNGNV*<br>*TESGCKECEELEEKNIKEFLQSFVHIVQMF*<br>*INTS* | An RLI with N72D mutation, IL-15Ra, a linker, and IL-15 (referred to as "RLI" from the N to C-terminus direction). IL-15Ra sushi+ sequence is underlined. IL-15 sequence is italicized; contains SEQ ID NO: 1176, SEQ ID NO: 1169, and SEQ ID NO: 1178 |

TABLE 4 below shows sequence of peptide-IL-15 agent complexes. For SEQ ID NO: 1317-SEQ ID NO: 1358 and SEQ ID NO: 1428-SEQ ID NO: 1431 in TABLE 4, the tag is shown in bold, the sushi domain is shown in underlining, the IL-15 agent linker is shown in italics, the IL-15 agent is shown in bold and underlining, the linker to the peptide is shown in bold and italics, the cleavable site is shown in italics and underlining, and the peptide is unformatted. For SEQ ID NO: 1434-SEQ ID NO: 1441 in TABLE 4 below show an IL-15Ra Sushi followed by IgG1 hinge (bold), a CH2+CH3 regions (Fc) (no formatting), a flexible linker (SEQ ID NO: 1359 or SEQ ID NO: 1362) (underlining), and a peptide of SEQ ID NO: 569 (shown in italics).

TABLE 4

Peptide-IL-15 Agent Complexes

| SEQ ID NO | Sequence |
|---|---|
| SEQ ID NO: 1317 | HHHHHHHHHHITCPPPMSVEHADIWVKSYSLYSRERYICNSG FKRKAGTSSLTECVLNKATNVAHWTTPSLKCIRDPALVHQRPA PP*SGGSGGGGSGGGSGGGGSL*QNWVNVISDLKKIEDLIQSMHI DATLYTESDVHPSCKVTAMKCFLLELQVISLESGDASIHDT VENLIILANNSLSSNGNVTESGCKECEELEEKNIKEFLQSFV HIVQMFINTS*GGGGSGGGGS**V*AGGGGSGGGGS*MCMPCFTTDH QMARKCDDCCGGKGRGKCYGPQCLCR |

TABLE 4-continued

Peptide-IL-15 Agent Complexes

| SEQ ID NO | Sequence |
| --- | --- |
| SEQ ID NO: 1318 | HHHHHHHHHHNWVNVISDLKKIEDLIQSMHIDATLYTESD VHPSCKVTAMKCFLLELQVISLESGDASIHDTVENLIILANN SLSSNGNVTESGCKECEELEEKNIKEFLQSFVHIVQMFINTS *SGGGSGGGGSGGGGSGGGGSGGGSL*QITCPPPMSVEHADIWVK SYSLYSRERYICNSGFKRKAGTSSLTECVLNKATNVAHWTTPS LKCIRDPALVHQRPAPP*GGGGSGGGGS*V*AGGGGSGGGGS*MCM PCFTTDHQMARKCDDCCGGKGRGKCYGPQCLCR |
| SEQ ID NO: 1319 | HHHHHHHHHHITCPPPMSVEHADIWVKSYSLYSRERYICNSG FKRKAGTSSLTECVLNKATNVAHWTTPSLKCIRDPALVHQRPA PP*SGGSGGGGSGGGSGGGGSL*QNWVNVISDLKKIEDLIQSMHI DATLYTESDVHPSCKVTAMKCFLLELQVISLESGDASIHDT VENLIILANNSLSSNGNVTESGCKECEELEEKNIKEFLQSFV HIVQMFINTSA*EAAAKEAAAKA*V*AEAAAKEAAAKA*MCMPCF TTDHQMARKCDDCCGGKGRGKCYGPQCLCR |
| SEQ ID NO: 1320 | MCMPCFTTDHQMARKCDDCCGGKGRGKCYGPQCLCR*GGGG SGGGGS*V*AGGGGSGGGGS*ITCPPPMSVEHADIWVKSYSLYSRE RYICNSGFKRKAGTSSLTECVLNKATNVAHWTTPSLKCIRDPA LVHQRPAPP*SGGSGGGGSGGGSGGGGSL*QNWVNVISDLKKIE DLIQSMHIDATLYTESDVHPSCKVTAMKCFLLELQVISLESG DASIHDTVENLIILANNSLSSNGNVTESGCKECEELEEKNIKE FLQSFVHIVQMFINTSHHHHHHHHHH |
| SEQ ID NO: 1321 | HHHHHHHHHHITCPPPMSVEHADIWVKSYSLYSRERYICNSG FKRKAGTSSLTECVLNKATNVAHWTTPSLKCIRDPALVHQRPA PP*SGGSGGGGSGGGSGGGGSL*QNWVNVISDLKKIEDLIQSMHI DATLYTESDVHPSCKVTAMKCFLLELQVISLESGDASIHDT VENLIILANNSLSSNGNVTESGCKECEELEEKNIKEFLQSFV HIVQMFINTS*GGGGSGGGGSGGGGS*MCMPCFTTDHQMARKC DDCCGGKGRGKCYGPQCLCR |
| SEQ ID NO: 1322 | DYKDDDDKIEGRITCPPPMSVEHADIWVKSYSLYSRERYICNS GFKRKAGTSSLTECVLNKATNVAHWTTPSLKCIRDPALVHQRP APP*SGGSGGGGSGGGSGGGGSL*QNWVNVISDLKKIEDLIQSM HIDATLYTESDVHPSCKVTAMKCFLLELQVISLESGDASIHD TVENLIILANNSLSSNGNVTESGCKECEELEEKNIKEFLQSF VHIVQMFINTS*GGGGSGGGGS*V*AGGGGSGGGGS*MCMPCFTTD HQMARKCDDCCGGKGRGKCYGPQCLCR |
| SEQ ID NO: 1323 | HHHHHHHHHHITCPPPMSVEHADIWVKSYSLYSRERYICNSG FKRKAGTSSLTECVLNKATNVAHWTTPSLKCIRDPALVHQRPA PP*SGGSGGGGSGGGSGGGGSL*QNWVNVISDLKKIEDLIQSMHI DATLYTESDVHPSCKVTAMKCFLLELQVISLESGDASIHDT VENLIILANNSLSSNGNVTESGCKECEELEEKNIKEFLQSFV HIVQMFINTS*GGGGSGGGGS*PLGLA*GGGGSGGGGS*MCMPCF TTDHQMARKCDDCCGGKGRGKCYGPQCLCR |
| SEQ ID NO: 1324 | HHHHHHHHHHNWVNVISDLKKIEDLIQSMHIDATLYTESD VHPSCKVTAMKCFLLELQVISLESGDASIHDTVENLIILANN SLSSNGNVTESGCKECEELEEKNIKEFLQSFVHIVQMFINTS SGGGSGGGGSGGGGSGGGGSGGGSLQITCPPPMSVEHADIWV KSYSLYSRERYICNSGFKRKAGTSSLTECVLNKATNVAHWTTP SLKCIRDPALVHQRPAPP*GGGGSGGGGSGGGGS*MCMPCFTTD HQMARKCDDCCGGKGRGKCYGPQCLCR |
| SEQ ID NO: 1325 | HHHHHHHHHHITCPPPMSVEHADIWVKSYSLYSRERYICNSG FKRKAGTSSLTECVLNKATNVAHWTTPSLKCIRDPALVHQRPA PP*SGGSGGGGSGGGSGGGGSL*QNWVNVISDLKKIEDLIQSMHI DATLYTESDVHPSCKVTAMKCFLLELQVISLESGDASIHDT VENLIILANNSLSSNGNVTESGCKECEELEEKNIKEFLQSFV HIVQMFINTSA*EAAAKEAAAKEAAAKA*MCMPCFTTDHQMAR KCDDCCGGKGRGKCYGPQCLCR |
| SEQ ID NO: 1326 | HHHHHHHHHHMCMPCFTTDHQMARKCDDCCGGKGRGKCY GPQCLCR*GGGGSGGGGSGGGGS*ITCPPPMSVEHADIWVKSYSL YSRERYICNSGFKRKAGTSSLTECVLNKATNVAHWTTPSLKCI RDPALVHQRPAPP*SGGSGGGGSGGGSGGGGSL*QNWVNVISDL KKIEDLIQSMHIDATLYTESDVHPSCKVTAMKCFLLELQVIS LESGDASIHDTVENLIILANNSLSSNGNVTESGCKECEELEE KNIKEFLQSFVHIVQMFINTS |

TABLE 4-continued

Peptide-IL-15 Agent Complexes

| SEQ ID NO | Sequence |
|---|---|

SEQ ID NO: 1327
**HHHHHHHHHHNWVNVISDLKKIEDLIQSMHIDATLYTESD
VHPSCKVTAMKCFLLELQVISLESGDASIHDTVENLIILANN
SLSSNGNVTESGCKECEELEEKNIKEFLQSFVHIVQMFINTS**
*SGGGSGGGGSGGGGSGGGGSGGGSL*QITCPPPMSVEHADIWVK
SYSLYSRERYICNSGFKRKAGTSSLTECVLNKATNVAHWTTPS
LKCIRDPALVHQRPAPP*GGGGSGGGGS*PLGLAG*GGGGSGGGGS*
MCMPCFTTDHQMARKCDDCCGGKGRGKCYGPQCLCR

SEQ ID NO: 1328
HHHHHHHHHHITCPPPMSVEHADIWVKSYSLYSRERYICNSG
FKRKAGTSSLTECVLNKATNVAHWTTPSLKCIRDPALVHQRPA
PP*SGGSGGGGSGGGSGGGGSL*Q**NWVNVISDLKKIEDLIQSMHI
DATLYTESDVHPSCKVTAMKCFLLELQVISLESGDASIHDT
VENLIILANNSLSSNGNVTESGCKECEELEEKNIKEFLQSFV
HIVQMFINTS**GS*VAGS*MCMPCFTTDHQMARRCDDCCGGRGR
GKCYGPQCLCR

SEQ ID NO: 1329
MCMPCFTTDHQMARRCDDCCGGRGRGKCYGPQCLCR*GGGGS
VAGGGGS***NWVNVISDLKKIEDLIQSMHIDATLYTESDVHPSC
KVTAMKCFLLELQVISLESGDASIHDTVENLIILANNSLSSN
GNVTESGCKECEELEEKNIKEFLQSFVHIVQMFINTS***SGGGS
GGGGSGGGGSGGGGSGGGSL*QITCPPPMSVEHADIWVKSYSLY
SRERYICNSGFKRKAGTSSLTECVLNKATNVAHWTTPSLKCIR
DPALVHQRPAPPHHHHHHHHHH

SEQ ID NO: 1330
ITCPPPMSVEHADIWVKSYSLYSRERYICNSGFKRKAGTSSLTE
CVLNKATNVAHWTTPSLKCIRDPALVHQRPAPP*SGGSGGGGSG
GGSGGGGSL*Q**NWVNVISDLKKIEDLIQSMHIDATLYTESDVH
PSCKVTAMKCFLLELQVISLESGDASIHDTVENLIILANNSLS
SNGNVTESGCKECEELEEKNIKEFLQSFVHIVQMFINTS***GGG
GSGGGGSVAGGGGSGGGGS*MCMPCFTTDHQMARKCDDCCGG
KGRGKCYGPQCLCR

SEQ ID NO: 1331
**NWVNVISDLKKIEDLIQSMHIDATLYTESDVHPSCKVTAMK
CFLLELQVISLESGDASIHDTVENLIILANNSLSSNGNVTESG
CKECEELEEKNIKEFLQSFVHIVQMFINTS***SGGGSGGGGSGG
GGSGGGGSGGGSL*QITCPPPMSVEHADIWVKSYSLYSRERYICN
SGFKRKAGTSSLTECVLNKATNVAHWTTPSLKCIRDPALVHQR
PAPP*GGGGSGGGGSVAGGGGSGGGGS*MCMPCFTTDHQMARK
CDDCCGGKGRGKCYGPQCLCR

SEQ ID NO: 1332
ITCPPPMSVEHADIWVKSYSLYSRERYICNSGFKRKAGTSSLTE
CVLNKATNVAHWTTPSLKCIRDPALVHQRPAPP*SGGSGGGGSG
GGSGGGGSL*Q**NWVNVISDLKKIEDLIQSMHIDATLYTESDVH
PSCKVTAMKCFLLELQVISLESGDASIHDTVENLIILANNSLS
SNGNVTESGCKECEELEEKNIKEFLQSFVHIVQMFINTS**AEA
AAKEAAAKAVAAEAAAKEAAAKA*MCMPCFTTDHQMARKCDD
CCGGKGRGKCYGPQCLCR

SEQ ID NO: 1333
MCMPCFTTDHQMARKCDDCCGGKGRGKCYGPQCLCR*GGGG
SGGGGSVAGGGGSGGGGS*ITCPPPMSVEHADIWVKSYSLYSRE
RYICNSGFKRKAGTSSLTECVLNKATNVAHWTTPSLKCIRDPA
LVHQRPAPP*SGGSGGGGSGGGSGGGGSL*Q**NWVNVISDLKKIE
DLIQSMHIDATLYTESDVHPSCKVTAMKCFLLELQVISLESG
DASIHDTVENLIILANNSLSSNGNVTESGCKECEELEEKNIKE
FLQSFVHIVQMFINTS**

SEQ ID NO: 1334
ITCPPPMSVEHADIWVKSYSLYSRERYICNSGFKRKAGTSSLTE
CVLNKATNVAHWTTPSLKCIRDPALVHQRPAPP*SGGSGGGGSG
GGSGGGGSL*Q**NWVNVISDLKKIEDLIQSMHIDATLYTESDVH
PSCKVTAMKCFLLELQVISLESGDASIHDTVENLIILANNSLS
SNGNVTESGCKECEELEEKNIKEFLQSFVHIVQMFINTS***GGG
GSGGGGSGGGGS*MCMPCFTTDHQMARKCDDCCGGKGRGKC
YGPQCLCR

SEQ ID NO: 1335
ITCPPPMSVEHADIWVKSYSLYSRERYICNSGFKRKAGTSSLTE
CVLNKATNVAHWTTPSLKCIRDPALVHQRPAPP*SGGSGGGGSG
GGSGGGGSL*Q**NWVNVISDLKKIEDLIQSMHIDATLYTESDVH
PSCKVTAMKCFLLELQVISLESGDASIHDTVENLIILANNSLS
SNGNVTESGCKECEELEEKNIKEFLQSFVHIVQMFINTS***GGG
GSGGGGGS*PLGLAG*GGGGSGGGGS*MCMPCFTTDHQMARKCDD
CCGGKGRGKCYGPQCLCR

TABLE 4-continued

Peptide-IL-15 Agent Complexes

| SEQ ID NO | Sequence |
|---|---|
| SEQ ID NO: 1336 | NWVNVISDLKKIEDLIQSMHIDATLYTESDVHPSCKVTAMK<br>CFLLELQVISLESGDASIHDTVENLIILANNSLSSNGNVTESG<br>CKECEELEEKNIKEFLQSFVHIVQMFINTS*SGGGSGGGGSGG<br>GGSGGGGSGGGSLQ*ITCPPPMSVEHADIWVKSYSLYSRERYICN<br>SGFKRKAGTSSLTECVLNKATNVAHWTTPSLKCIRDPALVHQR<br>PAPP*GGGGSGGGGSGGGGS*MCMPCFTTDHQMARKCDDCCGG<br>KGRGKCYGPQCLCR |
| SEQ ID NO: 1337 | ITCPPPMSVEHADIWVKSYSLYSRERYICNSGFKRKAGTSSLTE<br>CVLNKATNVAHWTTPSLKCIRDPALVHQRPAPP*SGGSGGGGSG<br>GGSGGGGSLQ*NWVNVISDLKKIEDLIQSMHIDATLYTESDVH<br>PSCKVTAMKCFLLELQVISLESGDASIHDTVENLIILANNSLS<br>SNGNVTESGCKECEELEEKNIKEFLQSFVHIVQMFINTS**AEA<br>AAKEAAAKEAAAKA*MCMPCFTTDHQMARKCDDCCGGKGRGK<br>CYGPQCLCR |
| SEQ ID NO: 1338 | MCMPCFTTDHQMARKCDDCCGGKGRGKCYGPQCLCR*GGGG<br>SGGGGSGGGGS*ITCPPPMSVEHADIWVKSYSLYSRERYICNSGF<br>KRKAGTSSLTECVLNKATNVAHWTTPSLKCIRDPALVHQRPAP<br>P*SGGSGGGGSGGGSGGGGSLQ*NWVNVISDLKKIEDLIQSMHID<br>ATLYTESDVHPSCKVTAMKCFLLELQVISLESGDASIHDTVE<br>NLIILANNSLSSNGNVTESGCKECEELEEKNIKEFLQSFVHIV<br>QMFINTS |
| SEQ ID NO: 1339 | NWVNVISDLKKIEDLIQSMHIDATLYTESDVHPSCKVTAMK<br>CFLLELQVISLESGDASIHDTVENLIILANNSLSSNGNVTESG<br>CKECEELEEKNIKEFLQSFVHIVQMFINTS*SGGGSGGGGSGG<br>GGSGGGGSGGGSLQ*ITCPPPMSVEHADIWVKSYSLYSRERYICN<br>SGFKRKAGTSSLTECVLNKATNVAHWTTPSLKCIRDPALVHQR<br>PAPP*GGGGSGGGGS*PLGLAG*GGGGSGGGGS*MCMPCFTTDHQM<br>ARKCDDCCGGKGRGKCYGPQCLCR |
| SEQ ID NO: 1340 | ITCPPPMSVEHADIWVKSYSLYSRERYICNSGFKRKAGTSSLTE<br>CVLNKATNVAHWTTPSLKCIRDPALVHQRPAPP*SGGSGGGGSG<br>GGSGGGGSLQ*NWVNVISDLKKIEDLIQSMHIDATLYTESDVH<br>PSCKVTAMKCFLLELQVISLESGDASIHDTVENLIILANNSLS<br>SNGNVTESGCKECEELEEKNIKEFLQSFVHIVQMFINTS*SV<br>AGS*MCMPCFTTDHQMARRCDDCCGGRGRGKCYGPQCLCR |
| SEQ ID NO: 1341 | MCMPCFTTDHQMARRCDDCCGGRGRGKCYGPQCLCR*GGGGS<br>VA*GGGGS*NWVNVISDLKKIEDLIQSMHIDATLYTESDVHPSC<br>KVTAMKCFLLELQVISLESGDASIHDTVENLIILANNSLSSN<br>GNVTESGCKECEELEEKNIKEFLQSFVHIVQMFINTS*SGGGS<br>GGGGSGGGGSGGGGSLQ*ITCPPPMSVEHADIWVKSYSLY<br>SRERYICNSGFKRKAGTSSLTECVLNKATNVAHWTTPSLKCIR<br>DPALVHQRPAPP |
| SEQ ID NO: 1343 | ITCPPPMSVEHADIWVKSYSLYSRERYICNSGFKRKAGTSSLTE<br>CVLNKATNVAHWTTPSLKCIRDPALVHQRPAPP*GGSGGGGSG<br>GGSGGGGSLQ*NWVNVISDLKKIEDLIQSMHIDATLYTESDVH<br>PSCKVTAMKCFLLELQVISLESGDASIHDTVENLIILANNSLS<br>SNGNVTESGCKECEELEEKNIKEFLQSFVHIVQMFINTS*GGG<br>GSGGGGSVAGGGGSGGGGS*MCMPCFTTDHQMARKCDDCCGG<br>KGRGKCYGPQCLCR |
| SEQ ID NO: 1344 | ITCPPPMSVEHADIWVKSYSLYSRERYICNSGFKRKAGTSSLTE<br>CVLNKATNVAHWTTPSLKCIRDPALVHQRPAPP*GGGSGGGGS<br>GGGSGGGGSLQ*NWVNVISDLKKIEDLIQSMHIDATLYTESDV<br>HPSCKVTAMKCFLLELQVISLESGDASIHDTVENLIILANNS<br>LSSNGNVTESGCKECEELEEKNIKEFLQSFVHIVQMFINTS*SG<br>GGGSGGGGSVAGGGGSGGGGS*MCMPCFTTDHQMARKCDDCC<br>GGKGRGKCYGPQCLCR |
| SEQ ID NO: 1345 | ITCPPPMSVEHADIWVKSYSLYSRERYICNSGFKRKAGTSSLTE<br>CVLNKATNVAHWTTPSLKCIRDPALVHQRPAPP*SGGSGGGGSG<br>GGSGGGGSLQ*NWVNVISDLKKIEDLIQSMHIDATLYTESDVH<br>PSCKVTAMKCFLLELQVISLESGDASIHDTVENLIILANNSLS<br>SNGNVTESGCKECEELEEKNIKEFLQSFVHIVQMFINTS*GGG<br>GSGGGGSVAGGGGSGGGGS*MCMPCFTTDHQMARACDDCCGG<br>AGRGKCYGPQCLCR |

TABLE 4-continued

Peptide-IL-15 Agent Complexes

| SEQ ID NO | Sequence |
|---|---|
| SEQ ID NO: 1346 | ITCPPPMSVEHADIWVKSYSLYSRERYICNSGFKRKAGTSSLTE CVLNKATNVAHWTTPSLKCIRDPALVHQRPAPP*SGGSGGGGSG GGSGGGGSL*QNWVNVISDLKKIEDLIQSMHIDATLYTESDVH PSCKVTAMKCFLLELQVISLESGDASIHDTVENLIILANNSLS SNGNVTESGCKECEELEEKNIKEFLQSFVHIVQMFINTS*GGG GSGGGGSVAGGGGSGGGGS*MCMPCFTTDHQMARRCDDCCGG RGRGKCYGPQCLCR |
| SEQ ID NO: 1347 | MCMPCFTTDHQMARKCDDCCGGKGRGKCYGPQCLCR*GGGG SVAGGGGS*NWVNVISDLKKIEDLIQSMHIDATLYTESDVHPS CKVTAMKCFLLELQVISLESGDASIHDTVENLIILANNSLSSN GNVTESGCKECEELEEKNIKEFLQSFVHIVQMFINTS*SGGGS GGGGSGGGGSGGGGSGGSL*QITCPPPMSVEHADIWVKSYSLY SRERYICNSGFKRKAGTSSLTECVLNKATNVAHWTTPSLKCIR DPALVHQRPAPP |
| SEQ ID NO: 1348 | MCMPCFTTDHQMARACDDCCGGAGRGKCYGPQCLCR*GGGG SVAGGGGS*NWVNVISDLKKIEDLIQSMHIDATLYTESDVHPS CKVTAMKCFLLELQVISLESGDASIHDTVENLIILANNSLSSN GNVTESGCKECEELEEKNIKEFLQSFVHIVQMFINTS*SGGGS GGGGSGGGGSGGGGSGGSL*QITCPPPMSVEHADIWVKSYSLY SRERYICNSGFKRKAGTSSLTECVLNKATNVAHWTTPSLKCIR DPALVHQRPAPP |
| SEQ ID NO: 1349 | ITCPPPMSVEHADIWVKSYSLYSRERYICNSGFKRKAGTSSLTE CVLNKATNVAHWTTPSLKCIRDPALVHQRPAPP*SGGSGGGGSG GGSGGGGSL*QNWVNVISDLKKIEDLIQSMHIDATLYTESDVH PSCKVTAMKCFLLELQVISLESGDASIHDTVENLIILANNSLS SNGNVTESGCKECEELEEKNIKEFLQSFVHIVQMFINTS$X_1X_2$ $X_3X_4X_5X_6X_7X_8X_9X_{10}X_{11}X_{12}X_{13}X_{14}X_{15}X_{16}X_{17}X_{18}X_{19}X_{20}X_{21}X_{22}X_{23}X_{24}$ $X_{25}X_{26}X_{27}X_{28}X_{29}X_{30}X_{31}X_{32}X_{33}X_{34}X_{35}X_{36}X_{37}X_{38}X_{39}X_{40}X_{41}X_{42}X_{43}X_{44}$ $X_{45}X_{46}X_{47}X_{48}X_{49}X_{50}$MCMPCFTTDHQMARKCDDCCGGKGRGKCY GPQCLCR |
| SEQ ID NO: 1350 | NWVNVISDLKKIEDLIQSMHIDATLYTESDVHPSCKVTAMK CFLLELQVISLESGDASIHDTVENLIILANNSLSSNGNVTESG CKECEELEEKNIKEFLQSFVHIVQMFINTS*SGGGSGGGGSGG GGSGGGGSGGGSL*QITCPPPMSVEHADIWVKSYSLYSRERYICN SGFKRKAGTSSLTECVLNKATNVAHWTTPSLKCIRDPALVHQR PAPP$X_1X_2X_3X_4X_5X_6X_7X_8X_9X_{10}X_{11}X_{12}X_{13}X_{14}X_{15}X_{16}X_{17}X_{18}X_{19}X_{20}X_{21}$ $X_{22}X_{23}X_{24}X_{25}X_{26}X_{27}X_{28}X_{29}X_{30}X_{31}X_{32}X_{33}X_{34}X_{35}X_{36}X_{37}X_{38}X_{39}X_{40}X_{41}$ $X_{42}X_{43}X_{44}X_{45}X_{46}X_{47}X_{48}X_{49}X_{50}$MCMPCFTTDHQMARKCDDCCGG KGRGKCYGPQCLCR |
| SEQ ID NO: 1351 | ITCPPPMSVEHADIWVKSYSLYSRERYICNSGFKRKAGTSSLTE CVLNKATNVAHWTTPSLKCIRDPALVHQRPAPP*SGGSGGGGSG GGSGGGGSL*QNWVNVISDLKKIEDLIQSMHIDATLYTESDVH PSCKVTAMKCFLLELQVISLESGDASIHDTVENLIILANNSLS SNGNVTESGCKECEELEEKNIKEFLQSFVHIVQMFINTSXXX XXXXXXXXXXXXXXXXXXXXXXXXXXXMCMPCFTTDHQMAR KCDDCCGGKGRGKCYGPQCLCR |
| SEQ ID NO: 1352 | NWVNVISDLKKIEDLIQSMHIDATLYTESDVHPSCKVTAMK CFLLELQVISLESGDASIHDTVENLIILANNSLSSNGNVTESG CKECEELEEKNIKEFLQSFVHIVQMFINTS*SGGGSGGGGSGG GGSGGGGSGGGSL*QITCPPPMSVEHADIWVKSYSLYSRERYICN SGFKRKAGTSSLTECVLNKATNVAHWTTPSLKCIRDPALVHQR PAPPXXXXXXXXXXXXXXXXXXXXXXXXXXXXXXXMCMPCF TTDHQMARKCDDCCGGKGRGKCYGPQCLCR |
| SEQ ID NO: 1353 | ITCPPPMSVEHADIWVKSYSLYSRERYICNSGFKRKAGTSSLTE CVLNKATNVAHWTTPSLKCIRDPALVHQRPAPP*SGGSGGGGSG GGSGGGGSL*QNWVNVISDLKKIEDLIQSMHIDATLYTESDVH PSCKVTAMKCFLLELQVISLESGDASIHDTVENLIILANNSLS SNGNVTESGCKECEELEEKNIKEFLQSFVHIVQMFINTS$X_1X_2$ $X_3X_4X_5X_6X_7X_8X_9X_{10}X_{11}X_{12}X_{13}X_{14}X_{15}X_{16}X_{17}X_{18}X_{19}X_{20}X_{21}X_{22}X_{23}X_{24}$ $X_{25}X_{26}X_{27}X_{28}X_{29}X_{30}X_{31}X_{32}X_{33}X_{34}X_{35}X_{36}X_{37}X_{38}X_{39}X_{40}X_{41}X_{42}X_{43}X_{44}$ $X_{45}X_{46}X_{47}X_{48}X_{49}X_{50}$MCMPCFTTDHQMARACDDCCGGAGRGKCY GPQCLCR |

TABLE 4-continued

Peptide-IL-15 Agent Complexes

| SEQ ID NO | Sequence |
|---|---|
| SEQ ID NO: 1354 | NWVNVISDLKKIEDLIQSMHIDATLYTESDVHPSCKVTAMK CFLLELQVISLESGDASIHDTVENLIILANNSLSSNGNVTESG CKECEELEEKNIKEFLQSFVHIVQMFINTS_SGGGSGGGGSGG GGSGGGGSGGGSL_QITCPPPMSVEHADIWVKSYSLYSRERYICN SGFKRKAGTSSLTECVLNKATNVAHWTTPSLKCIRDPALVHQR PAPPX$_1$X$_2$X$_3$X$_4$X$_5$X$_6$X$_7$X$_8$X$_9$X$_{10}$X$_{11}$X$_{12}$X$_{13}$X$_{14}$X$_{15}$X$_{16}$X$_{18}$X$_{19}$X$_{20}$X$_{21}$ X$_{22}$X$_{23}$X$_{24}$X$_{25}$X$_{26}$X$_{27}$X$_{28}$X$_{29}$X$_{30}$X$_{31}$X$_{32}$X$_{33}$X$_{34}$X$_{35}$X$_{36}$X$_{37}$X$_{38}$X$_{39}$X$_{40}$X$_{41}$ X$_{42}$X$_{43}$X$_{44}$X$_{45}$X$_{46}$X$_{47}$X$_{48}$X$_{49}$X$_{50}$MCMPCFTTDHQMARACDDCCGG AGRGKCYGPQCLCR |
| SEQ ID NO: 1355 | ITCPPPMSVEHADIWVKSYSLYSRERYICNSGFKRKAGTSSLTE CVLNKATNVAHWTTPSLKCIRDPALVHQRPAPP_SGGSGGGGSG GGSGGGGSL_NWVNVISDLKKIEDLIQSMHIDATLYTESDVH PSCKVTAMKCFLLELQVISLESGDASIHDTVENLIILANNSLS SNGNVTESGCKECEELEEKNIKEFLQSFVHIVQMFINTSX$_1$X$_2$ X$_3$X$_4$X$_5$X$_6$X$_7$X$_8$X$_9$X$_{10}$X$_{11}$X$_{12}$X$_{13}$X$_{14}$X$_{15}$X$_{16}$X$_{17}$X$_{18}$X$_{19}$X$_{20}$X$_{21}$X$_{22}$X$_{23}$X$_{24}$ X$_{25}$X$_{26}$X$_{27}$X$_{28}$X$_{29}$X$_{30}$X$_{31}$X$_{32}$X$_{33}$X$_{34}$X$_{35}$X$_{36}$X$_{37}$X$_{38}$X$_{39}$X$_{40}$X$_{41}$X$_{42}$X$_{43}$X$_{44}$ X$_{45}$X$_{46}$X$_{47}$X$_{48}$X$_{49}$X$_{50}$MCMPCFTTDHQMARRCDDCCGGRGRGKCY GPQCLCR |
| SEQ ID NO: 1356 | NWVNVISDLKKIEDLIQSMHIDATLYTESDVHPSCKVTAMK CFLLELQVISLESGDASIHDTVENLIILANNSLSSNGNVTESG CKECEELEEKNIKEFLQSFVHIVQMFINTS_SGGGSGGGGSGG GGSGGGGSGGGSL_QITCPPPMSVEHADIWVKSYSLYSRERYICN SGFKRKAGTSSLTECVLNKATNVAHWTTPSLKCIRDPALVHQR PAPPX$_1$X$_2$X$_3$X$_4$X$_5$X$_6$X$_7$X$_8$X$_9$X$_{10}$X$_{11}$X$_{12}$X$_{13}$X$_{14}$X$_{15}$X$_{16}$X$_{17}$X$_{18}$X$_{19}$X$_{20}$X$_{21}$ X$_{22}$X$_{23}$X$_{24}$X$_{25}$X$_{26}$X$_{27}$X$_{28}$X$_{29}$X$_{30}$X$_{31}$X$_{32}$X$_{33}$X$_{34}$X$_{35}$X$_{36}$X$_{37}$X$_{38}$X$_{39}$X$_{40}$X$_{41}$ X$_{42}$X$_{43}$X$_{44}$X$_{45}$X$_{46}$X$_{47}$X$_{48}$X$_{49}$X$_{50}$MCMPCFTTDHQMARRCDDCCGG RGRGKCYGPQCLCR |
| SEQ ID NO: 1357 | ITCPPPMSVEHADIWVKSYSLYSRERYICNSGFKRKAGTSSLTE CVLNKATNVAHWTTPSLKCIRDPALVHQRPAPPY$_1$Y$_2$Y$_3$Y$_4$Y$_5$Y$_6$ Y$_7$Y$_8$Y$_9$Y$_{10}$Y$_{11}$Y$_{12}$Y$_{13}$Y$_{14}$Y$_{15}$Y$_{16}$Y$_{17}$Y$_{18}$Y$_{19}$Y$_{20}$Y$_{21}$Y$_{22}$Y$_{23}$Y$_{24}$Y$_{25}$Y$_{26}$Y$_{27}$ Y$_{28}$Y$_{29}$Y$_{30}$Y$_{31}$Y$_{32}$Y$_{33}$Y$_{34}$Y$_{35}$Y$_{36}$Y$_{37}$Y$_{38}$Y$_{39}$Y$_{40}$Y$_{41}$Y$_{42}$Y$_{43}$Y$_{44}$Y$_{45}$Y$_{46}$Y$_{47}$ Y$_{48}$Y$_{49}$Y$_{50}$NWVNVISDLKKIEDLIQSMHIDATLYTESDVHPSCK VTAMKCFLLELQVISLESGDASIHDTVENLIILANNSLSSNGN VTESGCKECEELEEKNIKEFLQSFVHIVQMFINTSX$_1$X$_2$X$_3$X$_4$X$_5$ X$_6$X$_7$X$_8$X$_9$X$_{10}$X$_{11}$X$_{12}$X$_{13}$X$_{14}$X$_{15}$X$_{16}$X$_{17}$X$_{18}$X$_{19}$X$_{20}$X$_{21}$X$_{22}$X$_{23}$X$_{24}$X$_{25}$X$_{26}$ X$_{27}$X$_{28}$X$_{29}$X$_{30}$X$_{31}$X$_{32}$X$_{33}$X$_{34}$X$_{35}$X$_{36}$X$_{37}$X$_{38}$X$_{39}$X$_{40}$X$_{41}$X$_{42}$X$_{43}$X$_{44}$X$_{45}$X$_{46}$ X$_{47}$X$_{48}$X$_{49}$X$_{50}$MCMPCFTTDHQMARRCDDCCGGRGRGKCYGPQCL CR |
| SEQ ID NO: 1358 | NWVNVISDLKKIEDLIQSMHIDATLYTESDVHPSCKVTAMK CFLLELQVISLESGDASIHDTVENLIILANNSLSSNGNVTESG CKECEELEEKNIKEFLQSFVHIVQMFINTSY$_1$Y$_2$Y$_3$Y$_4$Y$_5$Y$_6$Y$_7$Y$_8$ Y$_9$Y$_{10}$Y$_{11}$Y$_{12}$Y$_{13}$Y$_{14}$Y$_{15}$Y$_{16}$Y$_{17}$Y$_{18}$Y$_{19}$Y$_{20}$Y$_{21}$Y$_{22}$Y$_{23}$Y$_{24}$Y$_{25}$Y$_{26}$Y$_{27}$Y$_{28}$Y$_{29}$ Y$_{30}$Y$_{31}$Y$_{32}$Y$_{33}$Y$_{34}$Y$_{35}$Y$_{36}$Y$_{37}$Y$_{38}$Y$_{39}$Y$_{40}$Y$_{41}$Y$_{42}$Y$_{43}$Y$_{44}$Y$_{45}$Y$_{46}$Y$_{47}$Y$_{48}$Y$_{49}$ Y$_{50}$ITCPPPMSVEHADIWVKSYSLYSRERYICNSGFKRKAGTSSL TECVLNKATNVAHWTTPSLKCIRDPALVHQRPAPPX$_1$X$_2$X$_3$X$_4$X$_5$ X$_6$X$_7$X$_8$X$_9$X$_{10}$X$_{11}$X$_{12}$X$_{13}$X$_{14}$X$_{15}$X$_{16}$X$_{17}$X$_{18}$X$_{19}$X$_{20}$X$_{21}$X$_{22}$X$_{23}$X$_{24}$X$_{25}$X$_{26}$ X$_{27}$X$_{28}$X$_{29}$X$_{30}$X$_{31}$X$_{32}$X$_{33}$X$_{34}$X$_{35}$X$_{36}$X$_{37}$X$_{38}$X$_{39}$X$_{40}$X$_{41}$X$_{42}$X$_{43}$X$_{44}$X$_{45}$X$_{46}$ X$_{47}$X$_{48}$X$_{49}$X$_{50}$MCMPCFTTDHQMARRCDDCCGGRGRGKCYGPQCL CR |
| SEQ ID NO: 1428 | ITCPPPMSVEHADIWVKSYSLYSRERYICNSGFKRKAGTSSLTE CVLNKATNVAHWTTPSLKCIRDPALVHQRPAPP_SGGSGGGGSG GGSGGGGSL_NWVNVISDLKKIEDLIQSMHIDATLYTESDVH PSCKVTAMKCFLLELQVISLESGDASIHDTVENLIILANNSLS SNGNVTESGCKECEELEEKNIKEFLQSFVHIVQMFINTS_GGG GSGGGGSVA̲GGGGSGGGGS_MCMPCFTTDHQMARRCDDCCGG RGRGRCYGPQCLCR |
| SEQ ID NO: 1429 | NWVNVISDLKKIEDLIQSMHIDATLYTESDVHPSCKVTAMK CFLLELQVISLESGDASIHDTVENLIILANNSLSSNGNVTESG CKECEELEEKNIKEFLQSFVHIVQMFINTS_SGGGSGGGGSGG GGSGGGGSGGGSL_QITCPPPMSVEHADIWVKSYSLYSRERYICN SGFKRKAGTSSLTECVLNKATNVAHWTTPSLKCIRDPALVHQR PAPP_GGGGSGGGGS VA̲GGGGSGGGGS_MCMPCFTTDHQMARR CDDCCGGRGRGRCYGPQCLCR |

TABLE 4-continued

Peptide-IL-15 Agent Complexes

| SEQ ID NO | Sequence |
| --- | --- |
| SEQ ID NO: 1430 | ITCPPPMSVEHADIWVKSYSLYSRERYICNSGFKRKAGTSSLTE<br>CVLNKATNVAHWTTPSLKCIRDPALVHQRPAPP*SGGSGGGGSG*<br>*GGSGGGGSLQ*NWVNVISDLKKIEDLIQSMHIDATLYTESDVH<br>PSCKVTAMKCFLLELQVISLESGDASIHDTVENLIILANNSLS<br>SNGNVTESGCKECEELEEKNIKEFLQSFVHIVQMFINTS*GSV*<br>*AGS*MCMPCFTTDHQMARRCDDCCGGRGRGRCYGPQCLCR |
| SEQ ID NO: 1431 | MCMPCFTTDHQMARRCDDCCGGRGRGRCYGPQCLCR*GGGGS*<br>*VAGGGGS*NWVNVISDLKKIEDLIQSMHIDATLYTESDVHPSC<br>KVTAMKCFLLELQVISLESGDASIHDTVENLIILANNSLSSN<br>GNVTESGCKECEELEEKNIKEFLQSFVHIVQMFINTS*SGGGS*<br>*GGGGSGGGGSGGGGSGGGSLQ*ITCPPPMSVEHADIWVKSYSLY<br>SRERYICNSGFKRKAGTSSLTECVLNKATNVAHWTTPSLKCIR<br>DPALVHQRPAPP |
| SEQ ID NO: 1434<br>IL15RaSushi-<br>IgG1-Fc-<br>Flexible Linker-<br>SEQ ID NO: 569 | ITCPPPMSVEHADIWVKSYSLYSRERYICNSGFKRKAGTSSL<br>TECVLNKATNVAHWTTPSLKCIRepkscdkthtcppcpapellggpsvflf<br>ppkpkdtlmisrtpevtcvvvdvshedpevkfnwyvdgvevhnaktkpreeqynstyrvvsv<br>ltvlhqdwlngkeykckvsnkalpapiektiskakgqprepqvytlppsrdeltknqvsltclvk<br>gfypsdiavewesngqpennykttppvldsdgsfflyskltvdksrwqqgnvfscsvmhealh<br>nhytqkslslspgkGGGGSGGGGSGGGGSMCMPCFTTDHQMARRCD<br>DCCGGRGRGKCYGPQCLCR<br><br>Two polypeptides having a sequence of SEQ ID NO: 1434 associated<br>with two polypeptides having a sequence of SEQ ID NO: 1177<br><br>Two polypeptides having a sequence of SEQ ID NO: 1434 associated<br>with two polypeptides having a sequence of SEQ ID NO: 1178 |
| SEQ ID NO: 1435<br>IL15RaSushi-<br>IgG1-Fc-CapB<br>Linker-SEQ ID<br>NO: 569 | ITCPPPMSVEHADIWVKSYSLYSRERYICNSGFKRKAGTSSL<br>TECVLNKATNVAHWTTPSLKCIRepkscdkthtcppcpapellggpsvflf<br>ppkpkdtlmisrtpevtcvvvdvshedpevkfnwyvdgvevhnaktkpreeqynstyrvvsv<br>ltvlhqdwlngkeykckvsnkalpapiektiskakgqprepqvytlppsrdeltknqvsltclvk<br>gfypsdiavewesngqpennykttppvldsdgsfflyskltvdksrwqqgnvfscsvmhealh<br>nhytqkslslspgkGGGGSGGGGSVAGGGGSGGGGSMCMPCFTTDH<br>QMARRCDDCCGGRGRGKCYGPQCLCR<br><br>Two polypeptides having a sequence of SEQ ID NO: 1435 associated<br>with two polypeptides having a sequence of SEQ ID NO: 1177<br><br>Two polypeptides having a sequence of SEQ ID NO: 1435 associated<br>with two polypeptides having a sequence of SEQ ID NO: 1178 |
| SEQ ID NO: 1436<br>IL15Ra-IgG1-Fc-<br>Flexible Linker-<br>SEQ ID NO: 569 | ITCPPPMSVEHADIWVKSYSLYSRERYICNSGFKRKAGTSSL<br>TECVLNKATNVAHWTTPSLKCIRDPALVHQRPAPPSTVTTA<br>GVTPQPESLSPSGKEPAASSPSSNNTAATTAAIVPGSQLMPS<br>KSPSTGTTEISSHESSHGTPSQTTAKNWELTASASHQPPGVY<br>PQGHSDTTepkscdkthtcppcpapellggpsvflfppkpkdtlmisrtpevtcvvvdvs<br>hedpevkfnwyvdgvevhnaktkpreeqynstyrvvsyltvlhqdwlngkeykckvsnkal<br>papiektiskakgqprepqvytlppsrdeltknqvsltclvkgfypsdiavewesngqpennykt<br>tppvldsdgsfflyskltvdksrwqqgnvfscsvmhealhnhytqkslslspgkGGGGSG<br>GGGSGGGGSMCMPCFTTDHQMARRCDDCCGGRGRGKCYGPQC<br>LCR<br><br>Two polypeptides having a sequence of SEQ ID NO: 1436 associated<br>with two polypeptides having a sequence of SEQ ID NO: 1177<br><br>Two polypeptides having a sequence of SEQ ID NO: 1436 associated<br>with two polypeptides having a sequence of SEQ ID NO: 1178 |
| SEQ ID NO: 1437<br>IL15Ra-IgG1-Fc-<br>CapB Linker-SEQ<br>ID NO: 569 | ITCPPPMSVEHADIWVKSYSLYSRERYICNSGFKRKAGTSSL<br>TECVLNKATNVAHWTTPSLKCIRDPALVHQRPAPPSTVTTA<br>GVTPQPESLSPSGKEPAASSPSSNNTAATTAAIVPGSQLMPS<br>KSPSTGTTEISSHESSHGTPSQTTAKNWELTASASHQPPGVY<br>PQGHSDTTepkscdkthtcppcpapellggpsvflfppkpkdtlmisrtpevtcvvvdvs<br>hedpevkfnwyvdgvevhnaktkpreeqynstyrvvsyltvlhqdwlngkeykckvsnkal<br>papiektiskakgqprepqvytlppsrdeltknqvsltclvkgfypsdiavewesngqpennykt<br>tppvldsdgsfflyskltvdksrwqqgnvfscsvmhealhnhytqkslslspgkGGGGSG<br>GGGSVAGGGGSGGGGSMCMPCFTTDHQMARRCDDCCGGRGR<br>GKCYGPQCLCR |

TABLE 4-continued

Peptide-IL-15 Agent Complexes

| SEQ ID NO | Sequence |
|---|---|
| | Two polypeptides having a sequence of SEQ ID NO: 1437 associated with two polypeptides having a sequence of SEQ ID NO: 1177 |
| | Two polypeptides having a sequence of SEQ ID NO: 1437 associated with two polypeptides having a sequence of SEQ ID NO: 1178 |
| SEQ ID NO: 1438<br>SEQ ID NO: 569-<br>Flexible Linker-<br>IL15RaSushi-<br>IgG1-Fc | *MCMPCFTTDHQMARRCDDCCGGRGRGKCYGPQCLCR*GGGGSG<br>GGGSGGGGSITCPPPMSVEHADIWVKSYSLYSRERYICNSGF<br>KRKAGTSSLTECVLNKATNVAHWTTPSLKCIRepkscdkthtcppc<br>papellggpsvflfppkpkdtlmisrtpevtcvvvdvshedpevkfnwyvdgvevhnaktkpr<br>eeqynstyrvvsvltvlhqdwlngkeykckvsnkalpapiektiskakgqprepqvytlppsrd<br>eltknqvsltclvkgfypsdiavewesngqpennykttppvldsdgsfflyskltvdksrwqqgn<br>vfscsvmhealhnhytqkslslspgk |
| | Two polypeptides having a sequence of SEQ ID NO: 1438 associated with two polypeptides having a sequence of SEQ ID NO: 1177 |
| | Two polypeptides having a sequence of SEQ ID NO: 1438 associated with two polypeptides having a sequence of SEQ ID NO: 1178 |
| SEQ ID NO: 1439<br>SEQ ID NO: 569-<br>CapB Linker-<br>IL15RaSushi-<br>IgG1-Fc | *MCMPCFTTDHQMARRCDDCCGGRGRGKCYGPQCLCR*GGGGSG<br>GGGSVAGGGGSGGGGSITCPPPMSVEHADIWVKSYSLYSRE<br>RYICNSGFKRKAGTSSLTECVLNKATNVAHWTTPSLKCIRep<br>kscdkthtcppcpapellggpsvflfppkpkdtlmisrtpevtcvvvdvshedpevkfnwyvd<br>gvevhnaktkpreeqynstyrvvsvltvlhqdwlngkeykckvsnkalpapiektiskakgqpr<br>epqvytlppsrdeltknqvsltclvkgfypsdiavewesngqpennykttppvldsdgsfflyskl<br>tvdksrwqqgnvfscsvmhealhnhytqkslslspgk |
| | Two polypeptides having a sequence of SEQ ID NO: 1439 associated with two polypeptides having a sequence of SEQ ID NO: 1177 |
| | Two polypeptides having a sequence of SEQ ID NO: 1439 associated with two polypeptides having a sequence of SEQ ID NO: 1178 |
| SEQ ID NO: 1440<br>SEQ ID NO: 569-<br>Flexible Linker-<br>IL15Ra-IgG1-Fc | *MCMPCFTTDHQMARRCDDCCGGRGRGKCYGPQCLCR*GGGGSG<br>GGGSGGGGSITCPPPMSVEHADIWVKSYSLYSRERYICNSGF<br>KRKAGTSSLTECVLNKATNVAHWTTPSLKCIRDPALVHQR<br>PAPPSTVTTAGVTPQPESLSPSGKEPAASSPSSNNTAATTAAI<br>VPGSQLMPSKSPSTGTTEISSHESSHGTPSQTTAKNWELTAS<br>ASHQPPGVYPQGHSDTTepkscdkthtcppcpapellggpsvflfppkpkdtlmi<br>srtpevtcvvvdvshedpevkfnwyvdgvevhnaktkpreeqynstyrvvsyltvlhqdwln<br>gkeykckvsnkalpapiektiskakgqprepqvytlppsrdeltknqvsltclvkgfypsdiave<br>wesngqpennykttppvldsdgsfflyskltvdksrwqqgnvfscsvmhealhnhytqkslsls<br>pgk |
| | Two polypeptides having a sequence of SEQ ID NO: 1440 associated with two polypeptides having a sequence of SEQ ID NO: 1177 |
| | Two polypeptides having a sequence of SEQ ID NO: 1440 associated with two polypeptides having a sequence of SEQ ID NO: 1178 |
| SEQ ID NO: 1441<br>SEQ ID NO: 569-<br>CapB Linker-<br>IL15Ra-IgG1-Fc | *MCMPCFTTDHQMARRCDDCCGGRGRGKCYGPQCLCR*GGGGSG<br>GGGSVAGGGGSGGGGSITCPPPMSVEHADIWVKSYSLYSRE<br>RYICNSGFKRKAGTSSLTECVLNKATNVAHWTTPSLKCIRD<br>PALVHQRPAPPSTVTTAGVTPQPESLSPSGKEPAASSPSSNN<br>TAATTAAIVPGSQLMPSKSPSTGTTEISSHESSHGTPSQTTA<br>KNWELTASASHQPPGVYPQGHSDTTepkscdkthtcppcpapellggps<br>vflfppkpkdtlmisrtpevtcvvvdvshedpevkfnwyvdgvevhnaktkpreeqynstyry<br>vsvltvlhqdwlngkeykckvsnkalpapiektiskakgqprepqvytlppsrdeltknqvsltcl<br>vkgfypsdiavewesngqpennykttppvldsdgsfflyskltvdksrwqqgnvfscsvmhe<br>alhnhytqkslslspgk |
| | Two polypeptides having a sequence of SEQ ID NO: 1441 associated with two polypeptides having a sequence of SEQ ID NO: 1177 |
| | Two polypeptides having a sequence of SEQ ID NO: 1441 associated with two polypeptides having a sequence of SEQ ID NO: 1178 |

TABLE 4-continued

Peptide-IL-15 Agent Complexes

| SEQ ID NO | Sequence |
| --- | --- |
| SEQ ID NO: 1173 A IL-15 hypergonist fusion with a peptide (RLIX; IL-15Ra, a linker, IL-15, and SEQ ID NO: 568, see FIG. 3A) | MAPRRARGCRTLGLPALLLLLLLRPPATRGDYKDDDDKIEGRI TCPPPMSVEHADIWVKSYSLYSRERYICNSGFKRKAGTSSLTEC VLNKATNVAHWTTPSLKCIRDPALVHQRPAPPGGSGGGGSGG GSGGGGSLQNWVNVISDLKKIEDLIQSMHIDATLYTESDVHPSC KVTAMKCFLLELQVISLESGDASIHDTVENLIILANNSLSSNGN VTESGCKECEELEEKNIKEFLQSFVHIVQMFINTSXXXXXXXXX XXXXXXXXXXXXXXXXXXXXXXXXXXXXXXXXXXXXX XXMCMPCFTTDHQMARKCDDCCGGKGRGKCYGPQCLCR |
| SEQ ID NO: 1174 A IL-15 hyperagonist fusion with a peptide (ILRX; IL-15, a linker, IL-15Ra, and SEQ ID NO: 568, see FIG. 4A) | MAPRRARGCRTLGLPALLLLLLLRPPATRGDYKDDDDKIEGRN WVNVISDLKKIEDLIQSMHIDATLYTESDVHPSCKVTAMKCFL LELQVISLESGDASIHDTVENLIILANNSLSSNGNVTESGCKECE ELEEKNIKEFLQSFVHIVQMFINTSSGGGSGGGGSGGGGSGGGG SGGGSLQITCPPPMSVEHADIWVKSYSLYSRERYICNSGFKRKA GTSSLTECVLNKATNVAHWTTPSLKCIRDPALVHQRPAPPXXX XXXXXXXXXXXXXXXXXXXXXXXXXXXXXXXXXXXXX XXXXXXXXMCMPCFTTDHQMARKCDDCCGGKGRGKCYGPQ CLCR |
| SEQ ID NO: 1233 X any amino acid | MAPRRARGCRTLGLPALLLLLLLRPPATRGDYKDDDDKIEGRI TCPPPMSVEHADIWVKSYSLYSRERYICNSGFKRKAGTSSLTEC VLNKATNVAHWTTPSLKCIRDPALVHQRPAPPGGSGGGGSGG GSGGGGSLQNWVNVISDLKKIEDLIQSMHIDATLYTESDVHPSC KVTAMKCFLLELQVISLESGDASIHDTVENLIILANNSLSSNGN VTESGCKECEELEEKNIKEFLQSFVHIVQMFINTSX$_1$X$_2$X$_3$X$_4$X$_5$X$_6$ X$_7$X$_8$X$_9$X$_{10}$X$_{11}$X$_{12}$X$_{13}$X$_{14}$X$_{15}$X$_{16}$X$_{17}$X$_{18}$X$_{19}$X$_{20}$X$_{21}$X$_{22}$X$_{23}$X$_{24}$X$_{25}$X$_{26}$X$_{27}$ X$_{28}$X$_{29}$X$_{30}$X$_{31}$X$_{32}$X$_{33}$X$_{34}$X$_{35}$X$_{36}$X$_{37}$X$_{38}$X$_{39}$X$_{40}$X$_{41}$X$_{42}$X$_{43}$X$_{44}$X$_{45}$X$_{46}$X$_{47}$ X$_{48}$X$_{49}$X$_{50}$MCMPCFTTDHQMARKCDDCCGGKGRGKCYGPQCLC R |
| SEQ ID NO: 1234 X any amino acid | MAPRRARGCRTLGLPALLLLLLLRPPATRGDYKDDDDKIEGRN WVNVISDLKKIEDLIQSMHIDATLYTESDVHPSCKVTAMKCFL LELQVISLESGDASIHDTVENLIILANNSLSSNGNVTESGCKECE ELEEKNIKEFLQSFVHIVQMFINTSSGGGSGGGGSGGGGSGGGG SGGGSLQITCPPPMSVEHADIWVKSYSLYSRERYICNSGFKRKA GTSSLTECVLNKATNVAHWTTPSLKCIRDPALVHQRPAPPX$_1$X$_2$ X$_3$X$_4$X$_5$X$_6$X$_7$X$_8$X$_9$X$_{10}$X$_{11}$X$_{12}$X$_{13}$X$_{14}$X$_{15}$X$_{16}$X$_{17}$X$_{18}$X$_{19}$X$_{20}$X$_{21}$X$_{22}$X$_{23}$X$_{24}$ X$_{25}$X$_{26}$X$_{27}$X$_{28}$X$_{29}$X$_{30}$X$_{31}$X$_{32}$X$_{33}$X$_{34}$X$_{35}$X$_{36}$X$_{37}$X$_{38}$X$_{39}$X$_{40}$X$_{41}$X$_{42}$X$_{43}$X$_{44}$X$_{45}$ X$_{46}$X$_{47}$X$_{48}$X$_{49}$X$_{50}$MCMPCFTTDHQMARKCDDCCGGKGRGKCY GPQCLCR |
| SEQ ID NO: 1503 IL-15 hypergonist fusion with CTX (an RLIX). containing: SEQ ID NO: 1232, SEQ ID NO: 1162, SEQ ID NO: 1176, SEQ ID NO: 1169, SEQ ID NO: 1177, and SEQ ID NO: 568 | MAPRRARGCRTLGLPALLLLLLLRPPATRGDYKDDDDKIEGRI TCPPPMSVEHADIWVKSYSLYSRERYICNSGFKRKAGTSSLTEC VLNKATNVAHWTTPSLKCIRDPALVHQRPAPPSGGSGGGGSG GGSGGGGSLQNWVNVISDLKKIEDLIQSMHIDATLYTESDVHP SCKVTAMKCFLLELQVISLESGDASIHDTVENLIILANNSLSSNG NVTESGCKECEELEEKNIKEFLQSFVHIVQMFINTSXXXXXXXX XXXXXXXXXXXXXXXXXXXXXXXXXXXXXXXXXXXXX XXXMCMPCFTTDHQMARKCDDCCGGKGRGKCYGPQCLCR |
| SEQ ID NO: 1504 IL-15 hypergonist fusion with CTX (an RLIX). Contains SEQ ID NO: 1176, SEQ ID NO: 1177, SEQ ID NO: 1169, SEQ ID NO: 1232, SEQ ID NO: 1162, and SEQ ID NO: 568 | MAPRRARGCRTLGLPALLLLLLLRPPATRGDYKDDDDKIEGRI TCPPPMSVEHADIWVKSYSLYSRERYICNSGFKRKAGTSSLTEC VLNKATNVAHWTTPSLKCIRDPALVHQRPAPPSGGSGGGGSG GGSGGGGSLQNWVNVISDLKKIEDLIQSMHIDATLYTESDVHP SCKVTAMKCFLLELQVISLESGDASIHDTVENLIILANNSLSSNG NVTESGCKECEELEEKNIKEFLQSFVHIVQMFINTSX$_1$X$_2$X$_3$X$_4$X$_5$ X$_6$X$_7$X$_8$X$_9$X$_{10}$X$_{11}$X$_{12}$X$_{13}$X$_{14}$X$_{15}$X$_{16}$X$_{17}$X$_{18}$X$_{19}$X$_{20}$X$_{21}$X$_{22}$X$_{23}$X$_{24}$X$_{25}$X$_{26}$ X$_{27}$X$_{28}$X$_{29}$X$_{30}$X$_{31}$X$_{32}$X$_{33}$X$_{34}$X$_{35}$X$_{36}$X$_{37}$X$_{38}$X$_{39}$X$_{40}$X$_{41}$X$_{42}$X$_{43}$X$_{44}$X$_{45}$X$_{46}$ X$_{47}$X$_{48}$X$_{49}$X$_{50}$MCMPCFTTDHQMARKCDDCCGGKGRGKCYGPQC LCR |

B. I/Os Comprising 4-1BB Ligands

In some embodiments, the present disclosure provides an I/O comprising a 4-1BB ligand, where the 4-1BB ligand of the present disclosure may optionally be an agonist, complexed with a peptide of this disclosure. A 4-1BB ligand of the present disclosure can be tumor necrosis factor ligand superfamily member 9, which is also referred to as 4-1BBL, TNFSF9, or TNFL9. A peptide-I/O complex comprising a peptide and a 4-1BB ligand can be referred to herein as a "peptide-4-1BB ligand complex." The 4-1BB ligand of the present disclosure can be secreted as a trimer, which is the active, receptor binding form of the natural human 4-1BB Ligand (4-1BBL) protein. In some embodiments, a 4-1BB ligand of the present disclosure in the peptide-4-1BB ligand complex can interact with 4-1BB expressed on various immune cells including, but not limited to, CD4+ T cells, CD8+ T cells, Tregs, B cells, NK cells, and myeloid cells (including DCs and osteoclasts). In further aspects, a 4-1BB ligand is fused to a trimerizing domain, such as a collagen C-propeptide of human collagen, or other trimerizing domain. In some embodiments, a 4-1BB ligand of the present disclosure in the peptide-4-1BB ligand complex can interact with 4-1BB expressed in the CNS. 4-1BB ligands can stimulate a Th1 response, including effector CD8+ T cells, NK cells, and DCs and promotes memory, growth, and enhanced effector functions (e.g., tumor cell lysis by effector CD8+ T cells). In some embodiments, 4-1BB ligands can induce cytokines, leukocyte proliferation, tumor inhibition, or any combination thereof. In some embodiments, 4-1BB ligand can inhibit Th2 and Th17 responses and AICD. In some embodiments, 4-1BB ligand can induce tumor regression in a human, non-human primate, or any other animal (Bartkowiak and Curran, Front Oncol 5:117 (2015)).

In some embodiments, the 4-1BB ligand can be a monoclonal antibody, CDR, or antibody fragment against 4-1BB. In some embodiments, a 4-1BB ligand that is a monoclonal antibody, CDR, or antibody fragment can elicit potent anti-tumor responses. The scFv of an anti-4-1BB monoclonal antibody can be an I/O that can be fused to a peptide of the disclosure. In some embodiments, the 4-1BB ligand can be urelumab or the scFv of urelumab, urelumab CDR, or urelumab antibody fragment. In some embodiments, the 4-1BB ligand is utomilumab or the scFv of utomilumab. Early clinical experience with urelumab and utomilumab has produced promising results including evidence of tumor responses (Chester 2018, Tolcher 2017, Segal 2018). However, there is also significant toxicity associated with these treatments (Atkins 2018, Chester 2018) and this suggests that successful 4-1BB ligand therapy will benefit from tumor targeting using the peptide-I/O complexes described herein.

Because 4-1BB ligands are active extracellularly, the present disclosure can provide a peptide-I/O complex comprising a peptide-4-1BB ligand complex in which the peptide can home, distribute to, target, migrate to, be processed by, or accumulate in the tumor microenvironment. In some embodiments, the peptide-4-1BB ligand complex can be chemically conjugated or recombinantly expressed as a fusion with a peptide of this disclosure. In some embodiments, the peptide and 4-1BB ligand I/O can be linked with a cleavable linker, such that the linker can be cleaved selectively in the tumor microenvironment, thereby releasing the 4-1BB ligand in high concentrations. Optionally, the peptide-4-1BB ligand complex is a prodrug that can have a lower potency prior to cleavage and a higher potency after cleavage. In some embodiments, the 4-1BB ligand I/O can access intracellular compartments, such as the endosome or lysosome endoplasmic reticulum or Golgi apparatus, due to the cell penetrating properties of the peptide. In such cases, the linker can be acid labile and can be cleaved in the acidic environment of the endosome, or the linker can be enzymatically labile and cleaved by enzymes in the endosome. This can be followed by cytokine recycling to the cell surface or extracellular space. In some embodiments, the 4-1BB ligand can be linked to the peptide by a stable linker and is active, but accumulates at higher levels in the tumor microenvironment because of peptide homing, cell penetration properties, or both. In some embodiments, the 4-1BB ligand can assemble into the endoplasmic reticulum and/or Golgi apparatus compartments, and can be subsequently expressed on the surface.

In some embodiments, the 4-1BB ligand can be expressed as a fusion protein with a trimerizing domain, such as the C-propeptide of human collagen (Tenascin-C trimerization domain; SEQ ID NO: 1370) (Cui et al. Sci Rep. 2018 May 9; 8(1):7327. doi: 10.1038/s41598-018-25652-w.; Berg et al. Cell Death Differ. 2007 December; 14(12):2021-34. Epub 2007 Aug. 17) or collagen alpha-1(XVIII) NC1 domain (SEQ ID NO: 1369) (Pan et al. Appl Microbiol Biotechnol. 2013 August; 97(16):7253-64. doi: 10.1007/s00253-012-4604-0. Epub 2012 Dec. 4.).

In some embodiments, when the 4-1BB ligand employed is a monoclonal antibody, the 4-1BB ligand can be chemically linked to multiple peptides of the present disclosure. In some embodiments, the 4-1BB ligand can be recombinantly fused to an scFv via a cleavable linker, which can be enzymatically cleaved extracellularly or after internalization during tumor cell processing. In other embodiments, the peptide-4-1BB ligand complex can be co-formulated. In some embodiments, the peptide-4-1BB ligand complex can be formulated in a delivery vehicle, such as a liposome. For example, the 4-1BB ligand can be formulated in a liposome nanoparticle, which can be coated with a peptide of the present disclosure. In other embodiments, a 4-1BB ligand mRNA can be encapsulated in a liposome, which can be further coated with a peptide of the present disclosure. In other embodiments, the 4-1BB ligand can be encoded for by an expression vector. DNA can be encapsulated in a liposome, which can be further coated with a peptide of the present disclosure. In these cases, a promoter can be used in the expression vector such that the 4-1BB ligand is only actively expressed once in cancer cells. In other embodiments, the 4-1BB ligand can be an agonist aptamer (Schrand 2014).

TABLE 5

4-1BB Ligands

| SEQ ID NO (if applicable) | 4-1BB Ligands | Description |
|---|---|---|
| SEQ ID NO: 1225 | QVQLQQWGAGLLKPSETLSLTCAVYGG SFSGYYWSWIRQSPEKGLEWIGEINHG GYVTYNPSLESRVTISVDTSKNQFSLK LSSVTAADTAVYYCARDYGPGNYDWYF DLWGRGTLVTVSSASTKGPSVFPLAPC SRSTSESTAALGCLVKDYFPEPVTVSW NSGALTSGVHTFPAVLQSSGLYSLSSV VTVPSSSLGTKTYTCNVDHKPSNTKVD KRVESKYGPPCPPCPAPEFLGGPSVFL KFPPKPDTLMISRTPEVTCVVVDVSQE DPEVQFNWYVDGVEVHNAKTKPREEQF NSTYRVVSVLTVLHQDWLNGKEYKCKV SNKGLPSSIEKTISKAKGQPREPQVYT LPPSQEEMTKNQVSLTCLVKGFYPSDI AVEWESNGQPENNYKTTPPVLDSDGSF FLYSRLTVDKSRVVQEGNVFSCSVMHE ALHNHYTQKSLSLSLGK | urelumab heavy chain |
| SEQ ID NO: 1226 | EIVLTQSPATLSLSPGERATLSCRASQ SVSSYLAWYQQKPGQAPRLLIYDASNR ATGIPARFSGSGSGTDFTLTISSLEPE DFAVYYCQQRSNWPPALTFCGGTKVEI KRTVAAPSVFIFPPSDEQLKSGTASVV CLLNNFYPREAKVQWKVDNALQSGNSQ ESVTEQDSKDSTYSLSSTLTLSKADYE KHKVYACEVTHQGLSSPVTKSFNRGEC | Urelumab light chain |

TABLE 5-continued 4-1BB Ligands

| SEQ ID NO (if applicable) | 4-1BB Ligands | Description |
|---|---|---|
| SEQ ID NO: 1227 | CPWAVSGARASPGSAASPRLREGPELS PDDPAGLLDLRQGMFAQLVAQNVLLID GPLSWYSDPGLAGVSLTGGLSYKEDTK ELVVAKAGVYYVFFQLELRRVVAGEGS GSVSLALHLQPLRSAAGAAALALTVDL PPASSEARNSAFGFQGRLLHLSAGQRL GVHLHTEARARHAWQLTQGATVLGLFR VTPEIPAGLPSPRSE | TNFSF9 |
| SEQ ID NO: 1228 | EVQLVQSGAEVKKPGESLRISCKGSGY SFSTYWISWVRQMPGKGLEWMGKIYPG DSYTNYSPSFQGQVTISADKSISTAYL QWSSLKASDTAMYYCARGYGIFDYWGQ GTLVTVSSASTKGPSVFPLAPCSRSTS ESTAALGCLVKDYFPEPVTVSWNSGAL TSGVHTFPAVLQSSGLYSLSSVVTVPS SNFGTQTYTCNVDHKPSNTKVDKTVER KCCVECPPCPAPPVAGPSVFLFPPKPK DTLMISRTPEVTCVVVDVSHEDPEVQF NWYVDGVEVHNAKTKPREEQFNSTFRV VSVLTWHQDWLNGKEYKCKVSNKGLPA PIEKTISKTKGQPREPQVYTLPPSREE MTKNQVSLTCLVKGFYPSDIAVEWESN GQPENNYKTTPPMLDSDGSFFLYSKLT VDKSRWQQGNVFSCSVMHEALHNHYTQ KSLSLSPGK | Utomilumab heavy chain |
| SEQ ID NO: 1229 | SYELTQPPSVSVSPGQTASITCSGDNI GDQYAHWYQQKPGQSPVLVIYQDKNRP SGIPERFSGSNSGNTATLTISGTQAMD EADYYCATYTGFGSLAVFGGGTKLTVL GQPKAAPSVTLFPPSSEELQANKATLV CLISDFYPGAVTVAWKADSSPVKAGVE TTTPSKQSNNKYAASSYLSLTPEQWKS HRSYSCQVTHEGSTVEKTVAPTECS | utomilumab light chain |

C. I/Os Comprising RIG-I Ligands

In some embodiments, the present disclosure provides an I/O comprising a RIG-I ligand or related ligands, such as MDA5 ligands or TLR3 ligands, complexed with a peptide of this disclosure. A peptide-I/O complex comprising a peptide and a RIG-I ligand can be referred to herein as a "peptide-RIG-I ligand complex." A peptide-I/O complex comprising a peptide and a MDA5 ligand can be referred to herein as a "peptide-MDA5 ligand complex." A peptide-I/O complex comprising a peptide and a TLR3 ligand can be referred to herein as a "peptide-TLR3 ligand complex."

TLR3 is an endosomal receptor and RIG-I and MDA5 is a cytoplasmic receptors for abnormal double stranded RNAs, comprising a 5' di or triphosphate (in the case of RIG-I), such as those associated with viral infection. RIG-I and MDA5 ligands can be effective at promoting antitumor immunity and apoptosis in mice (Wu 2017, Yu 2016). RIG-I and MDA5 are both RNA helicases, both have a C terminal domain involved in ligand specificity, and 2 N terminal CARD domains enabling MAVS mediated signal transduction, and both occur in the cytoplasm. Both recognize the internal RNA duplex structure, whereas RIG-I can also recognizes the 5' terminus of dsRNA (Wu 2013).

Ligand binding of RIG-I or MDA5 results in the activation of the MAVS dependent signaling pathway leading to the production of proinflammatory substances, including Type I IFNs that lead to antiviral and antitumor immunity (Elion 2018), and are distinct from the gene expression induced by TLR3 activation. Activation of RIG-I or MDA5 can additionally lead to the activation of the inflammasome resulting in changes to the tumor microenvironment that promotes antitumor immunity, such as secretion of IL-1, IL-18, and DAMPS. When poly I:C is transfected to target MDA5 rather than TLR3, it effectively enhances anti-tumor immunity in mice (Bhoopathi 2014). MDA5 and TLR3 recognize similar double stranded RNA ligands not requiring the 5' triphosphate (Linehan 2018). In particular, MDA5 and TLR3 both recognize poly I:C, but in different cell compartments. In addition to TLR3, other TLRs occur in the endosome that sense dsRNA, including TLR7, 8 and 10. In some embodiments, a RNA ligand can be conjugated to a peptide of this disclosure such that the complex activates RIG-I or MDA5, and in some cases in addition, activates one of the endosomal RNA sensing TLRs. In some cases, only the endosomal TLRs may be triggered or the complex may be specific for one or the other receptors.

Many organisms that result in human disease have so-called pathogen associated molecular patterns (PAMP) or microbial associated molecular patterns (MAMP), such as nucleic acids, sugars, or lipoproteins that can be detected by a host, such as by binding to pattern recognition receptors (PRRs), and activate innate immune responses protecting the host from infection. Abnormal RNA is a key pathogen associated molecular pattern (PAMP) from virus infection, leading to the initiation of antiviral immune responses. These RNAs can occur during viral infection, primarily with segmented negative strand viruses. These can include, but are not limited to, the highly pathogenic viruses, influenza, measles, mumps, respiratory syncytial virus (RSV), and parainfluenza, as well as Newcastle Disease Virus, Hanta, Marburg, Ebola, and rabies viruses. These RNAs can also occur upon infection with positive strand RNA viruses including Hepatitis C Virus, Japanese Encephalitis Virus, and also some DNA viruses including adenovirus, vaccinia, and herpes simplex virus. TLR3 recognizes RNA from reovirus, cytomegalovirus, herpes simplex virus, encephalomyocarditis virus (EMCV), flavivirus, and West Nile virus. TLR7 and TLR8, also in endosomes, recognize RNA produced by infection with Sendai virus (SeV), parainfluenza virus, influenza virus, coxsackie virus, vaccinia virus, measles virus (MV), respiratory syncytial virus (RSV), and retrovirus. TLR10 is another endosomal TLR that recognizes RNA, but less is known about its ligands. MDA5 recognizes dsRNA from EMCV, polio and coxsackie viruses, as well as reoviruses (Chen 2017).

RIG-I and MDA5 both signal through mitochondrial antiviral-signaling (MAVS) proteins, which initiates signaling via IRF3/7 and NF kappaB factors (Wu 2017). MAVS is also important for initiation, by RLR activation, of tumor cell apoptosis that leads to immunogenic cell death (ICD). Additionally, RIG-I can utilize multiple interferon regulatory factors (IRF). Thus engagement of RIG-I or MDA5 with a RIG-I-specific ligand can activate anti-viral immune mechanisms, which can have therapeutic effects against tumors. In some embodiments, engagement of RIG-I or MDA5 with a RIG-I ligand can induce direct immunogenic cell death (ICD) of tumor cells, but not normal cells. This can result in DC presentation of tumor antigens to the immune system. Engagement of RIG-I or MDA5 by the 5' triphosphate dsRNA can result in the secretion of pro-inflammatory cytokines Type I interferon (IFN), CXCL10, CCL5, IL-6, IL-23, TNFα, IFNβ, and others. In some embodiments, a RIG-I or MDA5 ligand can stimulate DC activation including inflammasome activity. In some embodiments, a RIG-I ligand can induce tumor cells to produce IFN and CXCL10 via the IRF3 pathway. As a result of the diverse immunogenic activity of RIG-I and MDA5 ligands, anti-tumor T cells can be induced. In some embodiments, a RIG-I or mDA5 ligand can induce tumor regression in a subject, such as a human, non-human primate, or any other animal (Bhoopathi 2014, Elion 2018). A RIG-I ligand can additionally inhibit a Th17 and Treg responses (Yang 2017).

In some embodiments, I/Os of the instant disclosure can target MDA5, a related cytoplasmic sensor for dsRNA, which shares many of the same functions as RIG-I. Both RIG-I and MDA5 belong to the RNA helicase family, both bind viral dsRNA, and signal via MAVS.

In some embodiments, the oligonucleotide ligand for RIG-I or other RNA sensors, will also contain sequences that function to regulate expression of specific genes. This could include antisense oligonucleotides (ASO), mRNAs, small interfering RNAs (siRNA), aptamers and microRNAs (miRNA) (Laina 2018) and non coding RNA (ncRNA), and splice correcting oligonucleotides (SCO) (Thierry 2006), and CRISPR-Cas9 system (Majo 2018). Such drugs can regulate translation of specific proteins or they can act to directly inhibit or activate specific protein targets.

RIG-I ligands can include dsRNA that is short (at least 5-60 base pairs, at least 5-10 base pairs, at least 7-10 base pairs, at least 11-18 base pairs, at least 14-120 base pairs, at least 5-15 base pairs, at least 15-25 base pairs, at least 25-40 base pairs, at least 40-60 base pairs, at least 60-80 base pairs, at least 80-100 base pairs, at least 100-120 base pairs, at least 120-140 base pairs, at least 140-160 base pairs, and, optimally, at least 19-60 base pair with at least one 5' triphosphate (diphosphate can also be tolerated), and an uncapped 5'A or G, a 5'triphosphate on a blunt end (a 1 nt 5' overlap, which is a 1 nucleotide overlap at the 5' end with the triphosphate, is also tolerable, see Hornung et al, Science. 2006 Nov. 10; 314(5801):994-7; Schmidt et al, Proc Natl Acad Sci USA. 2009 Jul. 21; 106(29):12067-72). At least one 5' triphosphate or 5'-diphosphate can preferably be located on the 5'-end of the sense strand in the resulting dsRNA. Mismatches can be tolerated within the dsRNA if distal from the 5'triphosphate, for example, if 8 or more base pairs from the 5' end. This also indicates that other RNA modifications, such as conjugation to a linker and or peptide of this disclosure, may be tolerated distal from the 5' triphosphate site, such as 8 or more base pairs from the 5' end. In some aspects, the dsRNA is a hairpin RNA some ribosides of which are paired with a partner within the same hairpin and further comprising a 5' triphosphate. Short 5' triphosphate dsRNAs that can be RIG-I ligands include those comprising the polyribonucleotides, as set forth in SEQ ID NO: 1180-SEQ ID NO: 1187, SEQ ID NO: 1203, SEQ ID NO: 1205, and SEQ ID NO: 1193-SEQ ID NO: 1202 (showing hairpin structures that can fold back upon themselves to create dsRNAs), as well as many other sequences that comprise 5' triphosphate and double stranded (as sense/antisense or as hairpin) RNA as described herein. It is understood that base paired regions of the dsRNA described herein may be paired polyribonucleotides in the context of a longer and/or a single strand of RNA sequence, or in the context of separate polyribonucleotides, that when paired contain the double-stranded portions as described herein.

Figure 5:
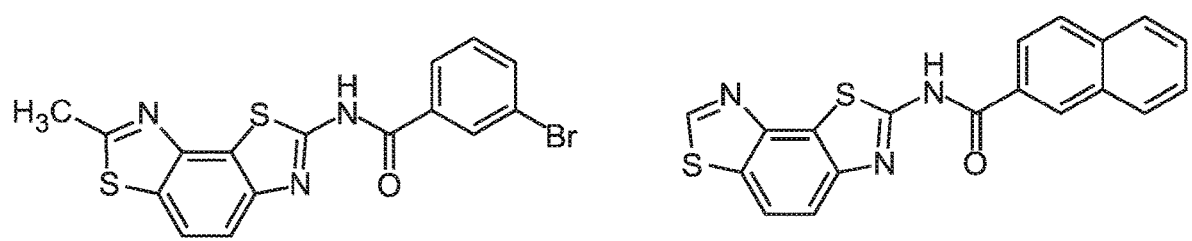
FIG. 5 illustrates two examples of I/Os comprising non-nucleic acid benzobisthiazole compounds, which can be RIG-I ligands, as provided by Probst et al. (Vaccine. 2017 Apr. 4; 35(15):1964-1971).
Figure 6:
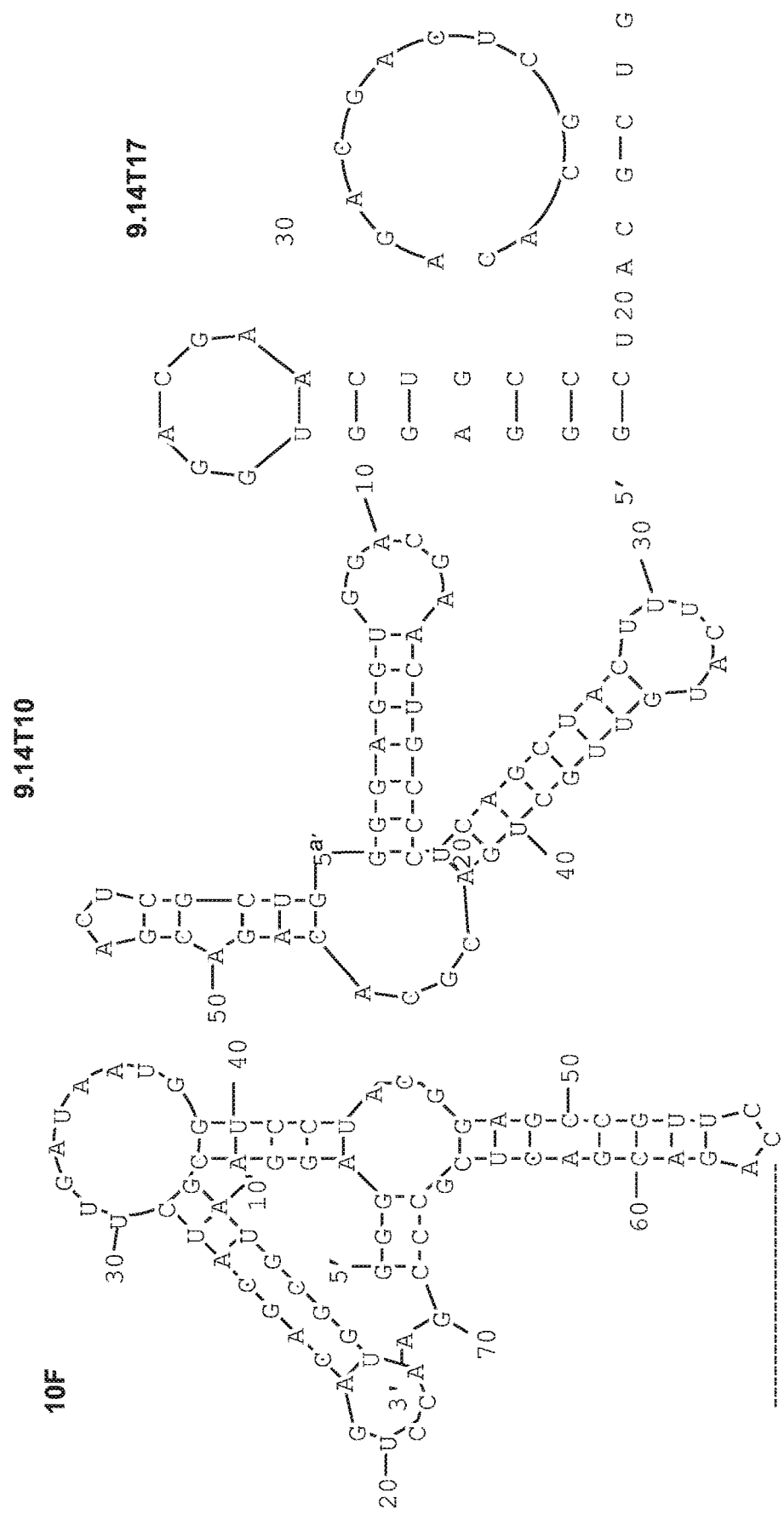
FIG. 6 illustrates examples of I/Os comprising RIG-I ligands, specifically single stranded RNA, as provided by Lee et al. (Nucleic Acid Therapeutics. 2016 26(3): 173-182).
Figure 6:
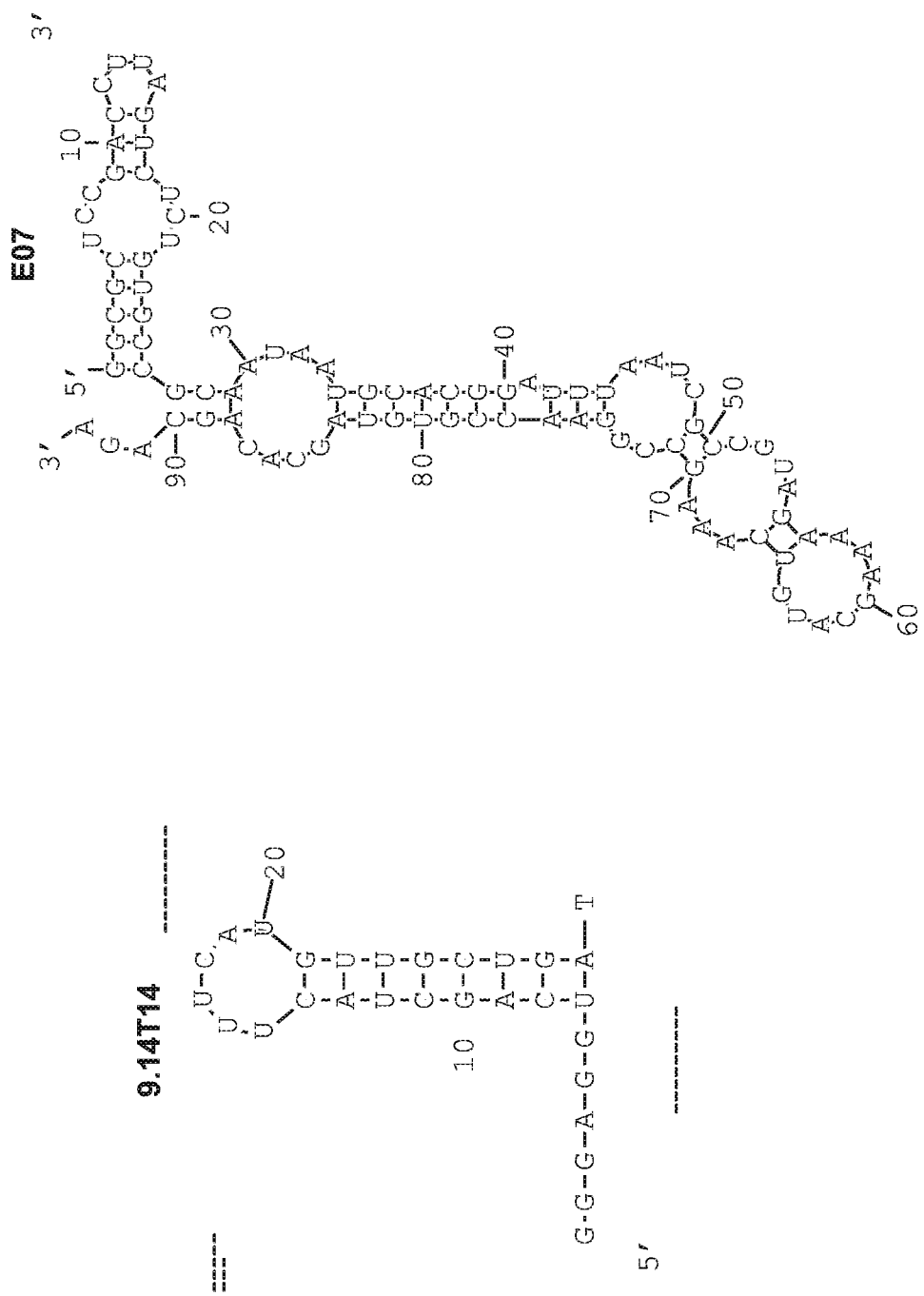

Additional sequences are also described in Schlee et al. (Immunity. 2009 Jul. 17; 31(1):25-34). Double stranded RNAs (dsRNAs) comprising RIG-I ligands can be made by a variety of techniques that are used to combine the sense and antisense strands of the RNAs into a double stranded form. In some embodiments, the sense and antisense strands of the dsRNA can be separately transcribed or synthesized and combined in to dsRNA structures using a variety of recombinant or synthetic techniques. In other embodiments, the sense and antisense strands of the dsRNA can be transcribed or synthesized in a single RNA that contains a loop structure (hairpin) that is optionally later cleaved by an RNAse to obtain the dsRNA. Loop structures (such as hairpins) can vary in polyribonucleotide length and composition. In some embodiments, a hairpin structure can have a loop structure. In other embodiments, a hairpin structure does not have a loop structure. In some embodiments, a hairpin structure comprises mismatches within the paired dsRNA structure. In some embodiments, short dsRNAs generated by RNase L via cleavage of U-rich cytosolic RNA can be RIG-I ligands. For segmented negative-strand RNA viruses, such RIG-I ligands can be found in "panhandles" formed by base pairing of conserved and complementary 5' and 3' genome ends, which can activate RIG-I. A RIG-I ligand corresponding to the Rabies panhandle is shown in SEQ ID NO: 1188 as an example. Some viruses evolved mismatches at the 5' ends of RNAs in order to evade RIG-I. Influenza virus genome promoters can be contained within their mostly complementary genome ends, and can form 5' ppp blunt-ended dsRNAs that can activate RIG-I (Anchisi et al. J Virol. 2015 Oct. 7; 90(1):586-90), such as those set forth in any one of SEQ ID NO: 1189-SEQ ID NO: 1192. Additional viral panhandle sequences that can serve as RIG-I ligands cam include SEQ ID NO: 1193-SEQ ID NO: 1198. RIG-I ligands described in Lee et al. (Nucleic Acids Res. 2016 Sep. 30; 44(17):8407-16), Goldeck et al. (Methods Mol Biol. 2014; 1169:15-25), and Schmidt et al. (Proc Natl Acad Sci USA. 2009 Jul. 21; 106(29):12067-72) can be additionally used herein as an I/O. As such then, a RIG-I ligand could comprise two RNA strands complexed together as a double strand, comprising 5' di- or tri-phosphate groups on one or both strands, or it could comprise a single RNA strand complexed together in a hairpin that is double stranded at one or more locations in the molecule. The double strand may extend throughout the sequence or there may be regions of mismatch, and there may be one or more locations of hairpin self association within one or both strands. In addition, the ends of the double strand may be at the same blunt location, or one or the other end may overhang. Hairpins and other structures within the RNA complex can be more immunogenic and activate the RIG-I pathway at higher levels. MDA5 ligands may also exhibit all the above structural variations, but may also contain no or one 5' phosphate. In some embodiments, the RIG-I ligands can be non-nucleic acid benzobisthiazole compounds as shown in FIG. 5 and as described in Probst et al. (Vaccine. 2017 Apr. 4; 35(15):1964-1971).

The RNA backbone or bases of a RIG-I ligand can be modified to improve in vitro and in vivo stability including serum stability, manufacturability, shelf stability, or other properties of the molecule including base pairing affinity and immune system activation. Pyrimidines can be 2'-fluoro-modified (Lee et al, Mol Ther. 2017 Jun. 7; 25(6):1295-1305), which can increase stability to nucleases as well as increase immune system activation. The RNA backbone can be phosphorothioate-substituted (where the non-bridging oxygen is replaced with sulfur), which can increase resistance to nuclease digestion as well as altering the biodistribution and tissue retention and increasing the pharmacokinetics such as by increasing protein binding, and can also induce more immune stimulation. Methyl phosphonate modification of an RNA can also be used. 2'-Omethyl and 2'-F RNA bases can be used, which can protect against base hydrolysis and nucleases and increase the melting temperature of duplexes. The modification can also comprise a bridged nucleic acid, a morpholino nucleic acid, a PNA, an LNA, an ethyl cEt nucleic acid. Bridged, Locked, and other similar forms of Bridged Nucleic Acids (BNA, LNA, cEt) where any chemical bridge such as an N—O linkage between the 2' oxygen and 4' carbons in ribose can be incorporated to increase resistance to exo- and endonucleases and enhance biostability. These include Bridged Nucleic Acids (BNA) where an N—O linkage between the 2' and 4' carbons occur and where any chemical modification of the nitrogen (including but not limited to N—H, N—$CH_3$, N-benzene) in the bridge can be added to increase stability RNA backbone or base modifications can be placed anywhere in the RNA sequence, at one, multiple, or all base locations. Optionally the modifications may be distal from the end of the dsRNA complex that contains the 5' triphosphate and interacts with the helicase. The RNA backbone or base modifications may enhance, decrease, or have no effect on the level of RIG-I activation by the peptide-RIG-I ligand complex. Optionally Phosphorothioate nucleic acids may be used at the 2-3 terminal nucleic acids of one or both sequences. Optionally 2'F modified nucleic acids may be used at least at 2-4 positions, at least 5%, at least 10% at least 25% of internal positions, at least 50%, at least 75%, or up to 100% of internal positions, all internal positions or all positions.

The RIG-I ligand may have additional modified nucleotides or bases present within the sequence, such as to allow chemical modification such as conjugation to a linker and peptide or conjugation to an additional delivery agent such as a lipid, cholesterol, or hydrocarbon chain.

Because RIG-I is active intracellularly, the present disclosure provides a peptide-RIG-I ligand complex in which the peptide can home, distribute to, target, migrate to, be processed by, or accumulate in the tumor microenvironment, or can be capable of cell penetration such that the RIG-I ligand can access the cytoplasm of the target cell. RIG-I ligands by themselves may be able to activate the RIG-I helicase when in contact with it, but when applied to cells in vivo or in vitro may access the cytoplasm at only low levels and thus not be able to access and activate RIG-I. Without a peptide of this disclosure, RIG-I ligands may require formulation with transfection reagents or other components to access the cytoplasm, which may not be feasible for human cancer therapy, due to toxicity, stability, safety issues, or inability to apply the formulation systemically (such as by intravenous or subcutaneous administration) and deliver sufficient amounts of active agent to the tumor. By combining a peptide of this disclosure with an I/O to create a peptide-I/O complex comprising peptide-RIG-I ligand complex, RIG-I can be activated in vivo for anti-cancer therapy. For example, the RIG-I ligand in the peptide-RIG-I I/O complex can access the cytoplasm of the target cell via cleavage of the peptide-I/O in the endosome or after exit from the endosome into the cytosol and dissociated RIG-I ligand therefrom can access the cytoplasm, or via any other mechanism as described herein. The RIG-I ligand can also optionally access the cytoplasm and RIG-I without cleavage. The peptide-RIG-I ligand complex can be designed such that the peptide is distal from the end of the RIG-I ligand that activates the helicase, and as such the peptide-RIG-I ligand complex may be active without cleavage. The interaction between RIG-I ligands and the RIG-I helicase, such as shown in the crystal structure in Devarker et al., Proc Natl Acad Sci, 113(3): 596-601, 2016, can be analyzed to design peptide-RIG-I ligand complexes. In the peptide-I/O complex, the peptides of this disclosure can be located a number of base pairs away from the 5'ppp end of the RIG-I I/O, such as 3, 4, 5, 6, 7, 8, 9, 10 11, 12, 13, 14, 15, 16, 17, 18, 19, 20 or more base pairs away from the 5'ppp end. In some embodiments, the peptide of this disclosure is conjugated 7-20 base pairs away from the 5'ppp end. In some embodiments, the peptide of this disclosure is conjugated more than 20 base pairs away from the 5'ppp end. In some embodiments, the RIG-I ligand I/O can be chemically conjugated to the peptide. For example, the peptide and RIG-I ligand I/O can be linked with a cleavable linker, such that the linker can be cleaved selectively once intracellular, such as in the endosome or cytosol, thereby releasing the RIG-I ligand adequately in high concentrations within a cell in order to target intracellular RIG-I. The peptide and RIG-I ligand can be linked such that the RIG-I is inactive or blocked from binding to its receptor by the peptide until the peptide is removed, thereby reducing exposure of noncancerous tissues to the I/O. For example, the linker can be a disulfide bond that is cleaved in the reducing environment of the cytosol, the endosomal-lysosomal pathway, on the surface of the cell, or in the tumor microenvironment. In other embodiments, the linker can be acid labile such that the linker is cleaved in the acidic environment of the endosomal-lysosomal pathway. In other embodiments, the linker can be enzymatically cleavable, such that it is cleaved by enzymes in the endosomal-lysosomal pathway, within the cytosol, or within the tumor microenvironment. In other embodiments, the peptide-RIG-I ligand complex can be cleaved as a part of a catabolic pathway. In other embodiments, the peptide-RIG-I ligand complex can be co-formulated. In some embodiments, the peptide-RIG-I ligand complex can be formulated in a delivery vehicle, such as a liposome. In other embodiments, the peptide-RIG-I ligand complex comprises a RIG-I ligand that can be encapsulated in a liposome, which can be further coated with a peptide of the present disclosure. In other embodiments, the peptide-RIG-I ligand complex can be linked by a stable linker and is active as a complex. The linker can comprise additional functions as peptides or chemical structures that enhance endosomal escape, endosomal uptake, tissue biodistribution to the tumor, or cell penetration. Cell penetrating or endosomal escape peptide sequences can be added to the linker or to the other end of the peptide. The linker can comprised hydrophobic domains (as (CH2)x where x=1-30), cholesterol, LCA, DHA, or DLA, hydrophilic domains (such as hydroxyl groups or oligoethylene glycol), or flexible domains that allow the peptide and RIG-I ligand freedom of movement for interaction with cellular components (such as (CH2-CH2-O)x where x=1-10, 1-30, 20-100, 100-1000).

Peptides of this disclosure can be cell penetrating, can be endocytosed, pinocytosed, taken up by cells, and or can access the cytoplasm of cells such as cancer cells. Peptides of this disclosure and some of its variants can bind preferentially to tumor cells by virtue of specificity for Annexin A2, a calcium regulated phospholipid binding protein (Lizarbe 2013) that is involved in endocytic membrane traffic (Morel 2009). Annexin A2 is overexpressed on the surface of cancer cells where it is associated with poor prognosis (Sharma 2018). Annexin A2 is involved in membrane trafficking events including microvesicle formation, vesicle aggregation, phagocytosis, and nucleotide and protein trafficking, and furthermore, has a role in the delivery of papilloma virus to endosomes and the transport of viral DNA to the nucleus via the MVE and TGN (Taylor 2018). Annexin A2 is also involved in the transport of therapeutic oligonucleotides and may facilitate endosomal release (Wang 2016). Given the role of Annexin A2 in DNA delivery and the known transport of chlorotoxin peptides into various endosomal compartments including the TGN (Wiranowska et al., Cancer Cell Intl 11:1-13 (2011)), peptide-RIG-I complexes of this disclosure can facilitate the delivery of RIG-I ligands to the cytoplasm. Likewise, in vivo studies also demonstrate the ability of pacifastin peptides, also known as LCMI-II peptides, THP1 peptides, and chymotrypsin inhibitors, to accumulate in and penetrate the cells of tumors (Sottero et al., Anticancer Research 38:51-60 (2018)), such as the peptides of SEQ ID NO: 1243-SEQ ID NO: 1262.

In some embodiments, exemplary peptide-I/O complexes of the present disclosure comprising a RIG-I ligand as the I/O are shown in the structures set forth in FIG. 34-FIG. 44 and FIG. 55-FIG. 79. In particular embodiments, a peptide-I/O complex of the present disclosure comprising a RIG-I ligand as the I/O is shown in FIG. 37. In some embodiments, a peptide-I/O complex of the present disclosure comprising a RIG-I ligand comprises a peptide comprising at least 80%, at least 85%, at least 90%, at least 91%, at least 92%, at least 93%, at least 94%, at least 95%, at least 96%, at least 97%, at least 98%, at least 99%, or at least 100% sequence identity to a peptide of SEQ ID NO: 569, comprises a stable linker, and comprises a RIG-ligand of SEQ ID NO: 1371.

In some embodiments, any one of SEQ ID NO: 1180-SEQ ID NO: 1206 can have at least a triphosphate or diphosphate on the 5' end of the sense strand. In some embodiments, SEQ ID NO: 1180-SEQ ID NO: 1206 can have one or more 5' triphosphate or one or more 5' diphosphate on the 5' end of the sense strand, the antisense strand, or both. In some embodiments, RIG-I stimulating activity of any one of SEQ ID NO: 1180-SEQ ID NO: 1206 can require the presence of 5'ppp on the sense strand. In other embodiments, any one of SEQ ID NO: 1180-SEQ ID NO: 1206 do not comprise 5' triphosphates. In some embodiments, incorporation of a 2'fluoropyrimidine into any one of the dsRNA sequences can enhance the activation of RIG-I, as discussed in Lee 2016. TABLE 6 below lists exemplary I/Os comprising exemplary RIG-I ligands of the present disclosure. In all sequences set forth in TABLE 6, the 5' end can comprise a 5' triphosphate (5'ppp), a, 5' diphosphate (5'pp), a, 5' monophosphate (5'p), or no phosphate.

| SEQ ID NO (if applicable) | RIG-I Ligands | Description |
|---|---|---|
| SEQ ID NO: 1180 | GACACACACACACACACACACUUU | 5'->3' strand of short dsRNA (sense) |
| SEQ ID NO: 1181 | CUGUGUGUGUGUGUGUGUGUGAAA | 3'->5' strand of short dsRNA (antisense) |
| SEQ ID NO: 1182 | AACACACACACACACACACACUUU | 5'->3' strand of short dsRNA (sense) |
| SEQ ID NO: 1183 | UUGUGUGUGUGUGUGUGUGUGAAA | 3'->5' strand of short dsRNA (antisense) |
| SEQ ID NO: 1184 | GACGACGACGACGACGACGACGAC GACGAC | 5'->3' strand of short dsRNA (sense) |
| SEQ ID NO: 1185 | CUGCUGCUGCUGCUGCUGCUGCUG CUGCUG | 3'->5' strand of short dsRNA (antisense) |
| SEQ ID NO: 1186 | GACGCUGACCCUGAAGUUCAUCUU | 5'->3' strand of short dsRNA (sense) |
| SEQ ID NO: 1187 | CUGCGACUGGGACUUCAAGUAGAA | 3'->5' strand of short dsRNA (antisense) |
| SEQ ID NO: 1188 | GACGCUUAACAAAUAAACAACAAA AAUGAGAAAAACAAUCAUAUGUCU GUUUUUUCUUUGAUCUGGUUGUUA AGCGUC | 5'->3' ssRNA resulting in hairpin structure of short 5' triphosphate dsRNAs; Rabies panhandle |
|  | Non-nucleic acid benzobisthiazole compounds | See FIG. 5 |
| SEQ ID NO: 1189 | GGCAAAAGCAGGGAGACAAAGACA AAAAGGC | 5'->3' Short dsRNA Flu genomic promoter sequence (sense) |
| SEQ ID NO: 1190 | CCGUUUUCGUCCCUCUGUUUCUGU UUUUCCG | 3'->5' Short dsRNA Flu genomic promoter sequence (antisense with evolved mismatch) |

-continued

| SEQ ID NO (if applicable) | RIG-I Ligands | Description |
|---|---|---|
| SEQ ID NO: 1191 | GGGAGAAACAAGGGCGGCAACAAC CAACAAA | Short dsRNA Flu genomic promoter sequence (sense) |
| SEQ ID NO: 1192 | CCCUCUUUGUUCCAUUUUAA | Short dsRNA Flu genomic promoter sequence (antisense with evolved mismatch) |
| SEQ ID NO: 1517 | aguagaaacaagggguauuuuucuu uaauugucguacuccuugauguca cucagugagugauuaucuacccug cuuuugcu | 5'->3' ssRNA resulting in hairpin structure of short Flu A genome (segment 5; NC_002019); see FIG. 14 |
| SEQ ID NO: 1518 | accaaacaaagauuuggugaauga cgagacuacacgccuuuuaucgua acucaccgauucucuguuuggu | 5'->3' ssRNA resulting in hairpin structure of short NDV genome (NC_002617) 5' end sense strand only; see FIG. 15 |
| SEQ ID NO: 1195 | ACCAGACAAGAGUUUAUCUCUUGU UUGGU | 5'->3' ssRNA resulting in hairpin structure of short RSV genome (NC-001803) |
| SEQ ID NO: 1235 | ACCAGACAAGAG | Short region of dsRNA derived from a cleaved SEQ ID NO: 1195; 5' → 3' (sense) |
| SEQ ID NO: 1236 | UGGUUUGUUCUC | Short region of dsRNA derived from a cleaved SEQ ID NO: 1195; 3' → 5' (antisense) |
| SEQ ID NO: 1196 | GAGCAGAAACAAGGCUUCGGCCUU GUUUCUGCUC | ssRNA resulting in hairpin structure of short Flu A panhandle sequence Lee 2016 supp |
| SEQ ID NO: 1237 | GAGCAGAAACAAGGC | Short region of dsRNA derived from a cleaved SEQ ID NO: 1196 5' → 3' (sense) |
| SEQ ID NO: 1238 | CUCGUCUUUGUUCCG | Short region of dsRNA derived from a cleaved SEQ ID NO: 1196 3' → 5' (antisense) |
| SEQ ID NO: 1197 | GGGACGCUGACCCAGAAGAUCUAC UAGAAAUAGUAGAUCUUCUGGGUC AGCGUCCC | 5'->3' ssRNA resulting in hairpin structure of short self-annealing hairpin RNA oligonucleotide that forms a strong intramolecular hairpin structure, thus automatically |

Figure 2:
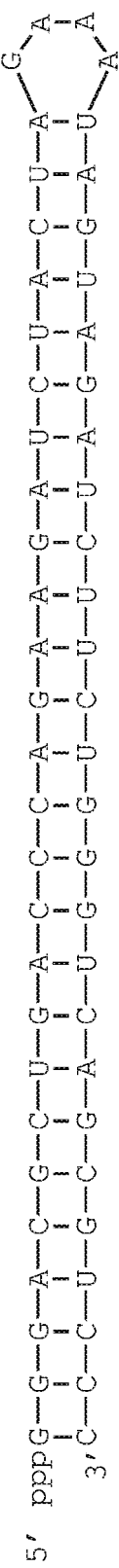
FIG. 2 illustrates an example of a RIG-I ligand, which was synthesized using 2'-fluoropyrimidines to increase backbone stability.

| SEQ ID NO (if applicable) | RIG-I Ligands | Description |
|---|---|---|
|  |  | forming a dsRNA molecule (IVT4) Goldeck 2014, also shown in FIG. 2 |
| SEQ ID NO: 1239 | GGGACGCUGACCCAGAAGAUCUACUA | Short region of dsRNA derived from a cleaved SEQ ID NO: 1197 5' → 3' (sense) |
| SEQ ID NO: 1240 | CCCUGCGACUGGGUCUUCUAGAUGAU | Short region of dsRNA derived from a cleaved SEQ ID NO: 1197 3' → 5' (antisense) |
| SEQ ID NO: 1198 | GGCUAGCGACCUCUGUUUGAUCAAACAGAGGUCGCAUGCC | 5'->3' ssRNA resulting in hairpin structure of short dsRNA (Schmidt 2009) |
| SEQ ID NO: 1241 | GGCAUGCGACCUCUGUUU | Short region of dsRNA derived from a cleaved SEQ ID NO: 1198 5' → 3' (sense) |
| SEQ ID NO: 1242 | CCGUACGCUGGAGACAAA | Short region of dsRNA derived from a cleaved SEQ ID NO: 1198 3' → 5' (antisense) |
| SEQ ID NO: 1199 | GGGAGGACGAUGCGGUACCUGACAGCAUCUUGAUAAUGGUCCUACGGAGCCGUUCCAGACGACUCGCCCGA | 5'->3' ssRNA resulting in hairpin structure of short dsRNA 10F targets Melanoma/melanocyte |
| SEQ ID NO: 1200 | GGCGCUCCGACCUUAGUCUCUGUGCCGCUAUAAUGCACGGAUUUAAUCGCCGUAGAAAAGCAUGUCAAAGCCGGAACCGUGUAGCACAGCAGA | 5'->3' ssRNA resulting in hairpin structure of short dsRNA E07 targets Epidermal growth factor receptor |
| SEQ ID NO: 1201 | GGGAGGUGGACGAACUGCCCUCAGCUACUUUCAUGUUGCUGACGCACAGACGACUCGCUG | 5'->3' ssRNA resulting in hairpin structure of short dsRNA 9.14T10 targets vWF |
| SEQ ID NO: 1202 | GGGAGGUGGACGAACUGCCCUACGCACAGACGACUCGCUG | 5'->3' ssRNA resulting in hairpin structure of short dsRNA 9.14T17 targets vWF |
| SEQ ID NO: 1203 | GGAUGCGGUACCUGACAGCAUCC | 5'->3' Short dsRNA RNA-23 (sense) |
| SEQ ID NO: 1204 | CCUACGCCAUGGACUGUCGUAGG | 3' -> 5' Short dsRNA RNA-23 (antisense) |
| SEQ ID NO: 1205 | GGCUAUACUGCGGACUAUUUGGCAAAGGAAGCAUUGACACAUGCGCCAAAUUUGCCUGCUCUACCAAGGCAAUAGGAAGAACCAUCUUGAAAGAGAAUAUCAAGUACGAAGUGGCCAUUUUUGUCCAUGGACCAACUACC | 5'->3' Short dsRNA RNA-140 sense (sense) |

| SEQ ID NO (if applicable) | RIG-I Ligands | Description |
|---|---|---|
| SEQ ID NO: 1206 | CCGAUAUGACGCCUGAUAAACCGU UUCCUUCGUAACUGUGUACGCGGU UUAAACGGACGAGAUGGUUCCGUU AUCCUUCUUGGUAGAACUUUCUCU UAUAGUUCAUGCUUCACCGGUAAA AACAGGUACCUGGUUGAUGG | 3' -> 5' Short dsRNA RNA-140 sense (antisense) |
| SEQ ID NO: 1371 | GCAUGCGACCUCUGUUUGAUCAAA CAGAGGUCGCAUGC | 5'->3' ssRNA resulting in hairpin structure of short dsRNA |
| SEQ ID NO: 1372 | GGCAUGCGACCUCUGUUUGAUCAA ACAGAGGUCGCAUGCC | 5'->3' ssRNA resulting in hairpin structure of short dsRNA |
| SEQ ID NO: 1373 | GGCAUGCGACCUCUGUUUGAUCAG AGGU | 5'->3' ssRNA resulting in hairpin structure of short dsRNA |
| SEQ ID NO: 1374 | GGCAUGCGACCUCUGUUUGAGGUC GCAUG | 5'->3' ssRNA resulting in hairpin structure of short dsRNA |
| SEQ ID NO: 1375 | GGACGUACGUUUCGACGUACGUCC | 5'->3' ssRNA resulting in hairpin structure of short dsRNA |
| SEQ ID NO: 1376 | GGAUCGAUCGAUCGUUCGCGAUCG AUCGAUCC | 5'->3' ssRNA resulting in hairpin structure of short dsRNA |
| SEQ ID NO: 1377 | AACACACACACACACACACACUUU GUGUGUGUGUGUGUGUGUGUGUU | 5'->3' ssRNA resulting in hairpin structure of short dsRNA |
| SEQ ID NO: 1378 | AACACACACACACACACACACUUU AAGUGUGUGUGUGUGUGUGUGUU | 5'->3' ssRNA resulting in hairpin structure of short dsRNA |
| SEQ ID NO: 1379 | GGACGUACGUUUCGCGACUGUAGA UUAAUCUACAGUCGCGAAACGUAC GUCC | 5'->3' ssRNA resulting in hairpin structure of short dsRNA |
| SEQ ID NO: 1380 | 5'GGAUCGAUCGAUCGUU | 5'->3' Short dsRNA RNA-16 (sense) |
| SEQ ID NO: 1381 | 3'CCUAGCUAGCUAGCGC | 5'->3' Short dsRNA RNA-16 (antisense) |
| SEQ ID NO: 1424 | 5'GCAUGCGACCUCUGUUUGA | 5'->3' Short dsRNA RNA-19 (sense) |
| SEQ ID NO: 1425 | 3' CGUACGCUGGAGACAAACU | 5'->3' Short dsRNA RNA-19 (antisense) |
| SEQ ID NO: 1426 | 5' GGACGUACGUUUCGCGA CUGUAGA | 5'->3' Short dsRNA RNA-24 (sense) |
| SEQ ID NO: 1427 | 3'-CCUGCAUGCAAAGCGCU GACAUCU | 5'->3' Short dsRNA RNA-24 (antisense) |

D. I/Os Comprising Stimulator of Interferon Genes Protein (STING) Ligands

Figure 7:
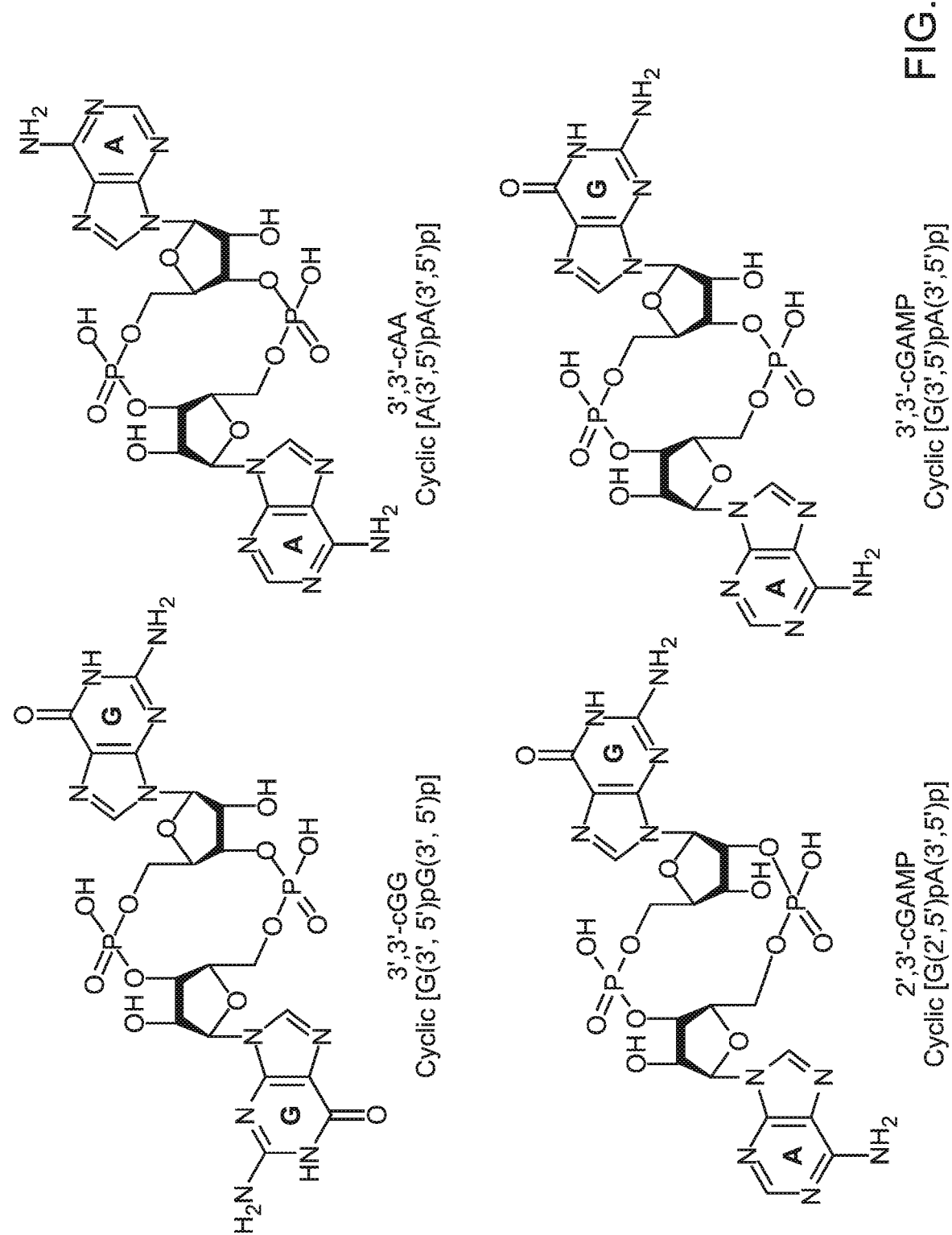
FIG. 7 illustrates STING ligands that can be complexed as an I/O with any peptide of the present disclosure, as provided by Kato et al. (J Interferon Cytokine Res. 2017 May; 37(5):207-213)).

In some embodiments, the present disclosure provides an I/O comprising a STING ligand, for example an agonist, complexed with a peptide of this disclosure. A peptide-I/O complex comprising a peptide and a STING ligand, such as a STING ligand acting as an agonist on its target can be referred to herein as a "peptide-STING ligand complex". STING is a key component of innate immunity to viral infections and can regulate Type I IFN production in response to cytosolic dsDNA (a viral signal). STING can react to cyclic dinucleotides (e.g. 2',3'-cGAMP as disclosed in Kato et al. (J Interferon Cytokine Res. 2017 May; 37(5):207-213)), which can be produced by the cytoplasmic enzyme cGAS (a pattern recognition receptor (PRR)). STING is a protein that can be present in the cytoplasm, associated with the ER, and can be a key regulator of the production of proinflammatory cytokines, such as Type I IFN, in response to infection of the cell by virus that release dsDNA. The presence of dsDNA in the cytoplasm can stimulate cGAS to catalyze synthesis of a cyclic dinucleotide (CDN). This molecule, termed 2'3'-cGAMP, can bind to STING with a much greater affinity than cGAMP molecules comprising other combinations of phosphodiester linkages, as described by Kato et al. (J Interferon Cytokine Res. 2017 May; 37(5):207-213). 2',3'-cGAMP can trigger STING to activate IRF3 and NF-kB signaling. 2',3'-cGAMP can be a physiological ligand for STING, although other cyclic dinucleotides are also active. FIG. 7 illustrates said STING ligands that can be complexed as an I/O with any peptide of the present disclosure, as provided by Kato et al. (J Interferon Cytokine Res. 2017 May; 37(5):207-213)). STING is located in association with the perinuclear endoplasmic reticulum (ER) and can translocate to the Golgi apparatus upon activation. In some embodiments, STING ligands can have synergy with an anti-PDL1 checkpoint inhibitor. In some embodiments, STING ligands promote effector CD8+ T cell-mediated anti-tumor activity. In some embodiments, a synergy and a promotion of T-cell mediated anti-tumor activity can be due to indirect activity of STING ligands, such as via interferon secretion. Intratumoral cyclic dinucleotides, of which 2'3'-cGAMP is a highly potent STING ligand, can be effective in inducing tumor regression. In some embodiments, STING ligands can trigger IRF3 and NFKB, resulting in production of Type I IFN and other pro-inflammatory cytokines by tumor cells and inflammasome assembly (including IL-1/IL-18 secretion). In some embodiments, STING ligands can promote tumor-specific effector T cell responses by activating interferon secretion and costimulatory ligand expression by myeloid cells after DC uptake of tumor cell-derived DNA. STING ligands have potent antitumor activity in mouse models of cancer, and several potent human STING ligands have advanced to clinical trials (Vargas et al, Eur J Cancer 75:86-97 (2017)). STING may also be stimulated indirectly by stimulating cGAS to produce cGAMP. cGAMP detects dsDNA in the cytoplasm in a length dependent manner. cGAS responds best to short (20 bp) or dsDNA of 50 bp or longer, derived from bacterial or viral pathogens as well as mtDNA in the cytoplasm. cGAS ligands include sstDNA, which is a single stranded stem loop structure such as occurs during HIV infection, such as:

```
                                  (SEQ ID NO: 1513)
CAGACGGGCACACACTACTTGAAGCACTCAAGGCA

AGCTTTATTGAGGCTTAAGCAGTGGGTTCCCTAGT
or (SEQ ID NO: 1514)
CAGGGGGGACCACTCTTAAGCCTCAAGGCAAGCTT

TGTTGAGGCTTAAGAGTGGTCCCGGGT
or
```

```
                                  (SEQ ID NO: 1515)
CAGGGGGGCACACACTACTTGAAGCACTCAAGGCA

AGCTTTGTTGAGGCTTAAGCAGTGGGTTCCCGGGT
(Herzner 2015).
```

Figure 8:
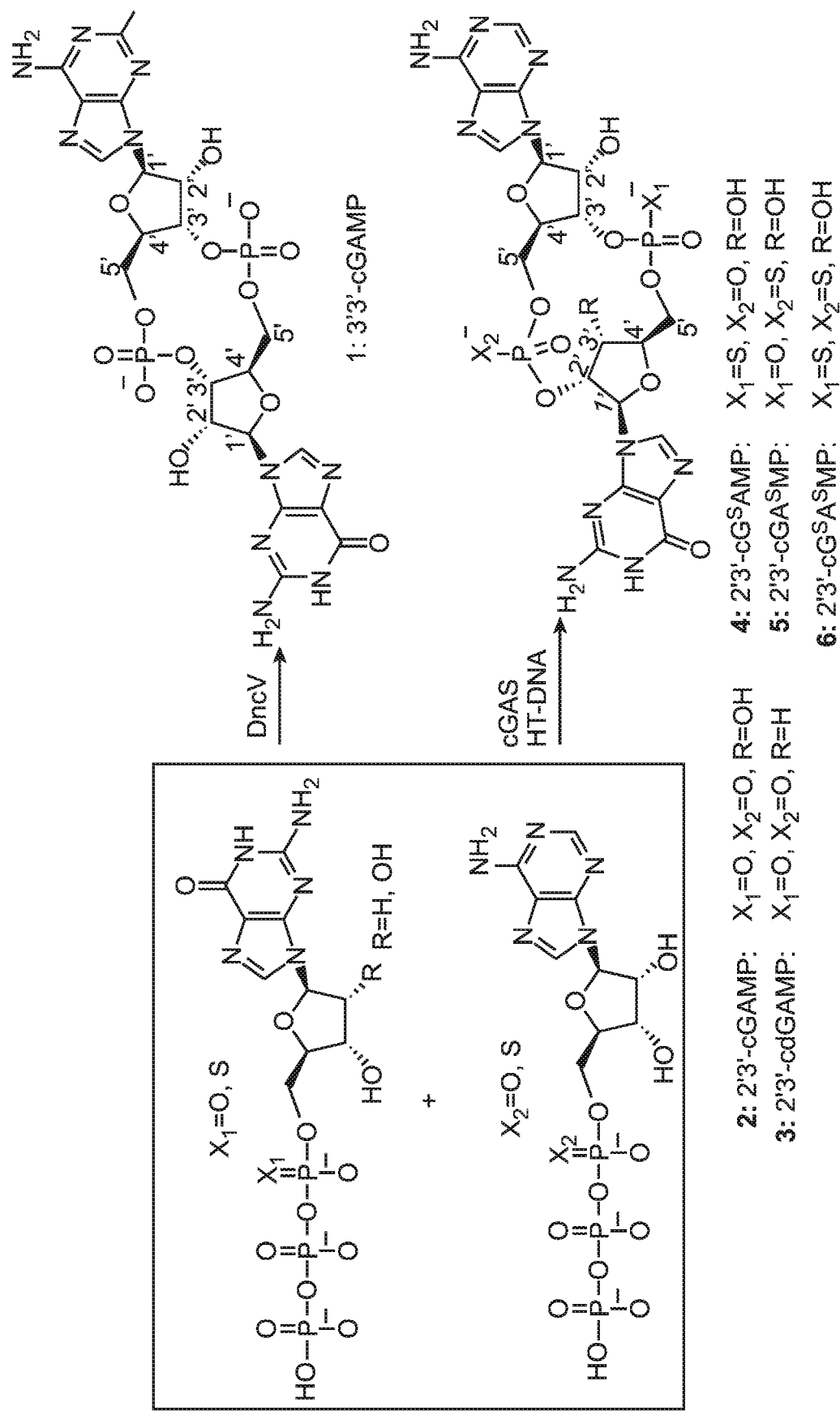
FIG. 8 illustrates cyclic-dinucleotides (CDNs) that can be complexed as an I/O with any peptide of the present disclosure, as provided by Li et al. (Nat Chem Biol. 2015 September; 11(9):741).
Figure 9:
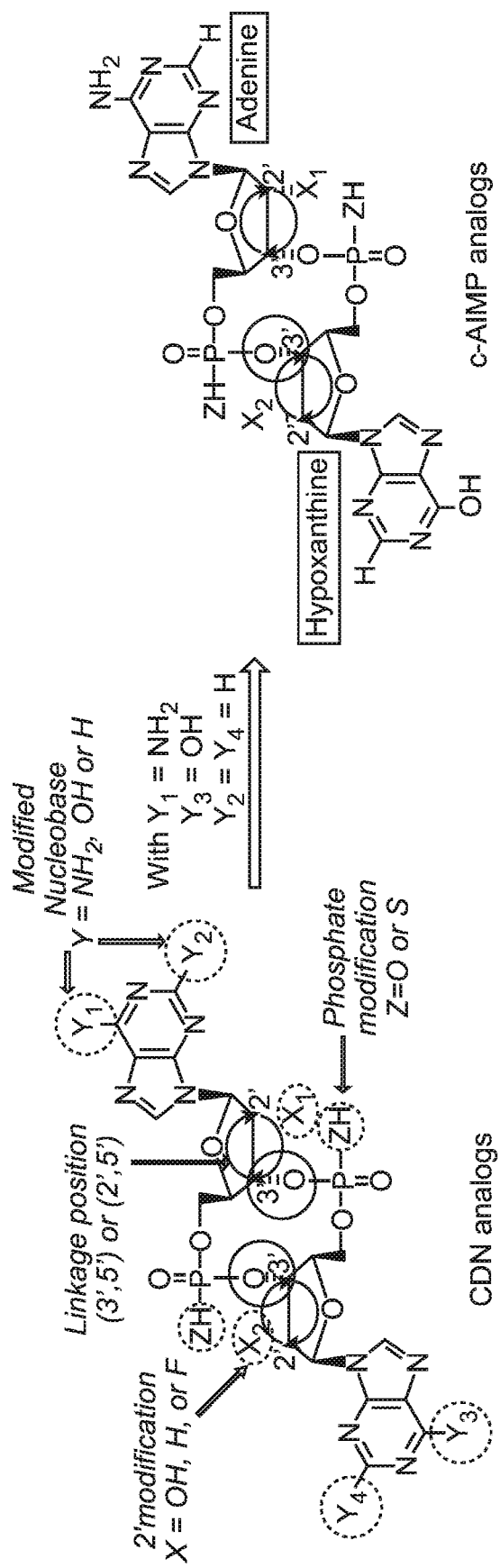
FIG. 9 illustrates cyclic-dinucleotides (CDNs) that can be complexed as an I/O with any peptide of the present disclosure, as provided by Lioux et al. (J Med Chem. 2016 Nov. 23; 59(22):10253-10267).

Cyclic dinucleotides (CDNs) are STING ligands that can have poor therapeutic efficacy due to their inability to access intracellular compartments, similarly to RIG-I and MDA5 ligands. Formulations of CDNs can facilitate the activation of antitumor immune responses in mouse models (Fu et al., Sci Transl Med. 2015 Apr. 15; 7(283):283ra52) and can have poor cell membrane permeability and metabolic instability, which in turn, can limit their applicability in medicine. Accordingly, medicinal chemistry efforts have been made to produce novel CDNs that are resistant to the degradation of cellular ecto-nucleotide pyrophosphatase/phosphodiesterase (ENPP1) (Li et al. (Nat Chem Biol. 2015 September; 11(9):741) and Lioux et al. (J Med Chem. 2016 Nov. 23; 59(22):10253-10267)). In some embodiments, the CDNs disclosed in Li et al. (Nat Chem Biol. 2015 September; 11(9):741) and Lioux et al. (J Med Chem. 2016 Nov. 23; 59(22):10253-10267) can be used as an I/O with any peptide of the present disclosure. Delivery of CDNs with nanoparticles or liposomes can improve their antitumor activity in vivo (Hanson et al., J Clin Invest. 2015 June; 125(6):2532-46). Additionally, a single S162A substitution in human STING can confer DMXAA sensitivity (Gao et al. Cell. 2013 Aug. 15; 154(4):748-62). In some embodiments, STING ligands of the present disclosure can be DMXAA analogs as disclosed in Gao et al. (Cell. 2013 Aug. 15; 154(4):748-62). G10, or 4-(2-chloro-6-fluorobenzyl)-N-(furan-2-ylmethyl)-3-oxo-3,4-dihydro-2H-benzo[b][1,4]thiazine-6-carboxamide can be a STING-specific agonist I/O of the instant disclosure can induce an antiviral response in human fibroblasts against alphaviruses (Sali et al. (PLoS Pathog. 2015 Dec. 8; 11(12):e1005324)). In some embodiments, G10, or 4-(2-chloro-6-fluorobenzyl)-N-(furan-2-ylmethyl)-3-oxo-3,4-dihydro-2H-benzo[b][1,4]thiazine-6-carboxamide can be a STING ligand, as disclosed in Sali et al. (PLoS Pathog. 2015 Dec. 8; 11(12):e1005324). In some embodiments, STING ligands of the present disclosure can be hydrolysis resistant analogs developed with phosphothioate linkages as disclosed in Li et al. (Nat Chem Biol. 2015 September; 11(9):741). For example, the enzyme ecto-nucleotide pyrophosphatase/phosphodiesterase (ENPP1) can be a dominant 2'3'-cGAMP hydrolase in cells, tissue extracts, and in blood, as reported by Li et al. (Nat Chem Biol. 2015 September; 11(9):741). These linkages can be used in place of either or both of the 2'-5' and the 3'-5' phosphodiester linkages (2'3'-cG$^S$A$^S$MP). Doubly substituted analog can be both active and resistant to hydrolysis. FIG. 8 illustrates exemplary CDNs that can be complexed as an I/O with any peptide of the present disclosure, as provided by Li et al. (Nat Chem Biol. 2015 September; 11(9): 741). In some embodiments, a STING ligand of the present disclosure can comprise one adenosine nucleoside and one inosine nucleoside (cAIMP) as set forth in Lioux et al. (J Med Chem. 2016 Nov. 23; 59(22):10253-10267). Analogs can be varied by sugar (ribose, 2'-deoxyribose, or 2'-fluoro-2'-deoxyribose), by inter-nucleotide linkage position (2',2'; 2',3'; 3',3'; or 3',2'), by phosphate modification (bis-phosphodiester or bis-phosphor-othioate), or combination thereof. FIG. 9 illustrates exemplary CDNs that can be complexed as an I/O with any peptide of the present disclosure, as provided by Lioux et al. (J Med Chem. 2016 Nov.

Figure 10:
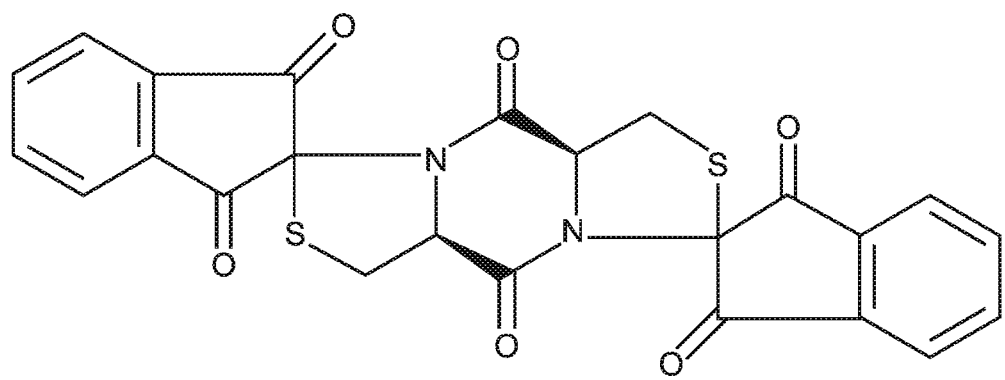
FIG. 10 illustrates a DSDP STING ligand that can be complexed as an I/O with any peptide of the present disclosure, as provided by Liu et al. (Antiviral Res. 2017 November; 147:37-46).
Figure 11:
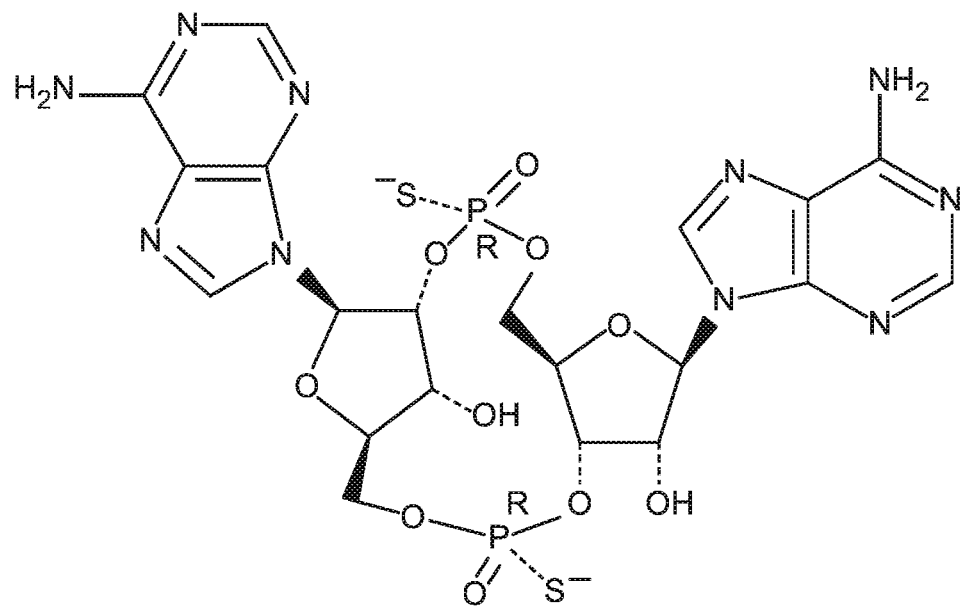
FIG. 11 illustrates synthetic analogs of cGAMP that can be complexed as an I/O with any peptide of the present disclosure, as provided in U.S. Pat. No. 9,724,408.
Figure 11:
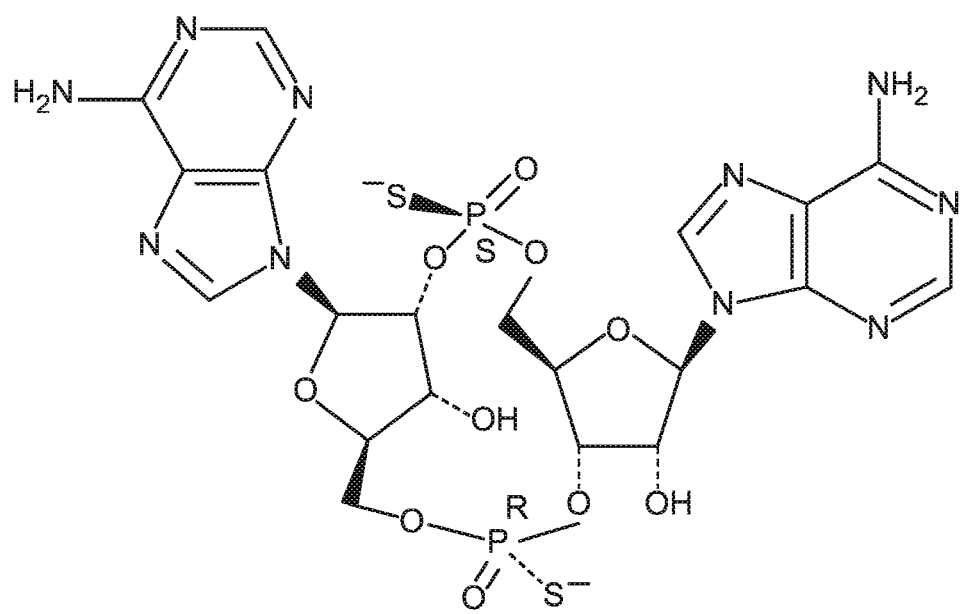

23; 59(22):10253-10267). In some embodiments, a STING ligand of the present disclosure can be dispiro diketopiperzine (DSDP), as set forth in Liu et al. (Antiviral Res. 2017 November; 147:37-46). FIG. 10 illustrates an exemplary DSDP STING ligand that can be complexed as an I/O with any peptide of the present disclosure, as provided by Liu et al. (Antiviral Res. 2017 November; 147:37-46). In some embodiments, a STING ligand of the present disclosure can be a synthetic analog of cGAMP, as set forth in U.S. Pat. No. 9,724,408, incorporated herein by reference. FIG. 11 illustrates exemplary synthetic analogs of cGAMP that can be complexed as an I/O with any peptide of the present disclosure, as provided in U.S. Pat. No. 9,724,408.

Analogs of cAIMP, varying by sugar (ribose, 2'-deoxyribose, or 2'-fluoro-2'-deoxyribose) and by inter-nucleotide linkage position (2',2'; 2',3'; 3',3'; or 3',2') and phosphate modification (bis-phosphodiester or bis-phosphorothioate) have been tested in the above listed papers and patents. TABLE 7, from Lioux et al. (J Med Chem. 2016 Nov. 23; 59(22):10253-10267), shows where sugar variations occur in the tested compound also shown in FIG. 9.

TABLE 7

| Compound | Linkage | X1 | X2 | Z |
|---|---|---|---|---|
| 9: 3',3'c-AIMP | 3',3' | OH | OH | O |
| 10: 2',3'c-AIMP | 2',3' | OH | OH | O |
| 23: 3',2'c-AIMP | 3',2' | OH | OH | O |
| 27: 2',2'c-AIMP | 2',2' | OH | OH | O |
| 13: cAIM(PS)$_2$ | 3',3' | OH | OH | S |
| 51: c-(dAMP-dIMP) | 3',3' | H | H | O |
| 52: c-(2'FdAMP-2'FdIMP) | 3',3' | F | F | O |
| 53: c-[2'FdAMP(S)-2'FdIMP(S)] | 3',3' | F | F | S |
| 54: c-(2'FdAMP-dIMP) | 3',3' | H | F | O |
| 55: c-(dAMP-2'FdIMP) | 3',3' | F | H | O |
| 56) c-[2'FdAM(PS)-dIM(PS)] | 3',3' | F | H | S |

All of the above analogs can be I/Os that agonize STING. Analogs 9, 10, 23, 51, 54, and 55 are equivalent in activity to 2',3'-cGAMP and analogs 13, 52, 53, 56 can be more potent than 2',3'-cGAMP.

Because STING is active intracellularly, the present disclosure provides a peptide-STING ligand complex in which the peptide can home, distribute to, target, migrate to, be processed by, or accumulate in the tumor microenvironment, or can be capable of cell penetration. In some embodiments, the peptide can continue to traffic through intracellular compartments, including the endosome or lysosome, and reach the transgolgi region where STING can reside. In some embodiments, the peptide-STING ligand complex can be chemically conjugated to a peptide of this disclosure. For example, a peptide and STING ligand I/O can be linked with a cleavable linker, such that the linker is cleaved selectively once intracellular, thereby releasing the STING ligand in high concentrations in order to target intracellular STING. The linker can be a disulfide linkage that can be cleaved by the reducing environment of the cytosol or the reducing environment of the endosomal/lysosomal pathway, can be enzymatically cleavable and cleaved by enzymes in the cytosol or in the endosomal/lysosomal pathway, or can be acid labile such that the linker can be cleaved in the acidic environment of the endosomal-lysosomal pathway. In some embodiments, the peptide-STING ligand complex can be linked by a stable linker. In some embodiments, the peptide-STING ligand complex can be active as a complex or can be catabolized into active metabolites. In other embodiments, the peptide-STING ligand complex can be co-formulated. In some embodiments, the peptide-STING ligand complex can be formulated in a delivery vehicle, such as a liposome. In other embodiments, a STING ligand can be encapsulated in a liposome, which can be further coated with a peptide of the present disclosure.

TABLE 8

STING Ligands

Description

Cyclic dinucleotides

3',3'-cGAMP (see FIG. 8 for structure)

2',3'-cGAMP (see FIG. 8 for structure)

3',3'c-diGMP

3',3'c-diAMP

3',3'c-AIMP

3',3'-cGG

3',3'-cAA

2',3'-cdGAMP (see FIG. 8 for structure)

2'3'-cGsAMP (see FIG. 8 for structure)

2'3'-cGAVP (see FIG. 8 for structure)

2'3'-cGsAsMP (see FIG. 8 for structure)

Synthetic analog of 3',3'c-AIMP

DMXAA analogs 4-(2-chloro-6-fluorobenzyl)-N-(furan-2-ylmethyl)-3-oxo-3,4-dihydro-2H-benzo[b][1,4]thiazine-6-carboxamide hydrolysis resistant analogs developed with phophothioate linkages Synthetic analog of 2',3'c-GAMP dispiro diketopiperzine (DSDP)

synthetic analog of cGAMP

3',3' c-AIMP (see TABLE 7)

2',3'c-AIMP (see TABLE 7)

3',2'c-AIMP (see TABLE 7)

2',2'c-AIMP (see TABLE 7)

cAIM(PS)2 (see TABLE 7)

c-(dAMP-dIMP) (see TABLE 7)

c-(2'FdAMP-2'FdIMP) (see TABLE 7)

c-[2'FdAMP(S)-2'FdIMP(S)](see TABLE 7)

c-(2'FdAMP-dIMP) (see TABLE 7)

c-(dAMP-2'FdIMP) (see TABLE 7)

c-[2'FdAM(PS)-dIM(PS)](see TABLE 7)

2,7,2",2"-dispiro[indene-1",3"-dione]-tetrahydrodithiazolo[3,2-a:3',2'-d]pyrazine-5,10(5aH, 10aH)-dione

ML-RS-52-CDA

ML-RR-S2-CDA

TABLE 8-continued

STING Ligands

Description

Disodium dithio-(RP, RP)-[cyclic[A(2',5')
pA(3',5')p]]
(also referred to as STINGVAX; Fu et al,
Sci Transl Med 7:283ra52 (2015)))

Flavone acetic acid (FAA)

CAGACGGGCACACACTACTTGAAGCACTCAAGGCAAGCTTTATT
GAGGCTTAAGCAGTGGGTTCCCTAGT (SEQ ID NO: 1513;
cGAS ligand that can indirectly stimulate STING)

CAGGGGGGACCACTCTTAAGCCTCAAGGCAAGCTTTGTTGAGGC
TTAAGAGTGGTCCCGGGT (SEQ ID NO: 1514;
cGAS ligand that can indirectly stimulate STING)

CAGGGGGGCACACACTACTTGAAGCACTCAAGGCAAGCTTTGTTGA
GGCTTAAGCAGTGGGTTCCCGGGT (SEQ ID NO: 1515;
cGAS ligand that can indirectly stimulate STING)

E. I/Os Comprising MDA5, TLR, or RLR Ligands

In some embodiments, the present disclosure provides an I/O comprising an MDA5 ligand, a TLR ligand, or an RLR ligand, complexed with a peptide of this disclosure. In some embodiments, any of the foregoing ligands are acting as an agonist. A peptide-I/O complex comprising a peptide and an MDA5 ligand can be referred to herein as a "peptide-MDA5 ligand complex." A peptide-I/O complex comprising a peptide and a TLR ligand can be referred to herein as a "peptide-TLR ligand complex." A peptide-I/O complex comprising a peptide and a RLR ligand can be referred to herein as a "peptide-RLR ligand complex."

RIG-I and MDA5 are related cytoplasmic sensor proteins. Both are RNA helicases and have a C terminal domain involved in ligand specificity and two N terminal CARD domains enabling MAVS mediated signal transduction. Both can recognize the dsRNA duplex structure, however, RIG-I can also recognizes the phosphate groups at the 5' terminus of some dsRNAs (Wu 2013). MDA5 can recognize double stranded RNA, like poly I:C, but unlike RIG-I, MDA5 does not require a 5' triphosphate, a 5' cap of ribose 2'-O-methylation, or both. TABLE 6 above also lists exemplary I/Os comprising exemplary MDA5 ligands of the present disclosure, wherein the sequences do not contain a 5' triphosphate (5'ppp), a, 5'diphosphate (5'pp), a, 5' monophosphate (5'p), or 5' cap of ribose 2'-O-methylation, or any one or more of the foregoing. In some embodiments, an MDA5 ligand lacks a 5'triphosphate or lack a 5' cap of ribose 2'-O-methylation, or both. Poly I:C is also a ligand for TLR3 and, thus, is a TLR3 I/O. TLR3 can function as an endosomal sensor for double stranded RNA. Ligand binding of RIG-I or MDA5 can result in activation of the MAVS dependent signaling pathway, leading to the production of proinflammatory substances, including Type I IFNs that lead to antiviral and antitumor immunity (Elion 2018), which can be distinct from the gene expression induced by TLR3 activation. Activation of RIG-I or MDA5 can also lead the activation of the inflammasome resulting in changes to the tumor microenvironment that promotes antitumor immunity, such as secretion of IL-1, IL-18, and DAMPS. When poly I:C is transfected to target MDA5 rather than TLR3, it can effectively enhance anti-tumor immunity in mice (Bhoopathi 2014). In addition to TLR3, other TLRs, including TLR7, TLR8 and TLR10, occur in the endosome and lysosome that sense dsRNA, ssRNA, and RNA degradation products (Miyake 2018). TLR9, which is also present in the endosome, can recognize unmethylated CpG oligodeoxynucleotides. TLR7 and TLR8 bind small molecule ligands that function as agonists, such as resiquimod (R-848) and imiquimod synthetic imidazoquinoline compounds, which are used for topical treatment of papilloma virus warts. Motolimod, a small molecule TLR8 agonist, can also be used in cancer therapy (Ferris 2018, Dang 2018). In some embodiments, the present disclosure provides an I/O comprising a ligand of the endolysosomal TLR family and said TLR ligand can be complexed with a peptide of this disclosure to form a peptide-TLR ligand complex. Such peptide-TLR ligand complexes may act as agonists of the TLR.

Other RNA and DNA sensing TLRs can also occur in endosomes, likely due to the common use of endocytosis in viral infection pathways. Targeting of endocytic pathways by peptide-I/O complexes of this disclosure, such as those having an I/O comprising an MDA5 ligand I/O (peptide-MDA5 ligand complex) or TLR I/O (peptide-TLR ligand I/O) can be used to activate these TLR pathways.

In some embodiments, the present disclosure provides an RLR ligand that activates both an RLR and a TLR, as an I/O to be complexed with a peptide of this disclosure. Endosomal entry of peptide-I/O complexes disclosed herein enables targeting of the endosome resident TLR. Additionally, the ability to promote endosomal release of peptide-nucleic acid conjugates can enable cytoplasmic RLR targeting. An RLR ligand as an I/O in a peptide peptide-I/O complex disclosed herein can target an RLR as well as one or more TLRs by a single drug which can significantly enhance signaling and response of the peptide-I/O complexes. Enhanced immune responses can occur due to the combination of modulating or activating distinct signaling pathways utilized by TLR and RLR, including the MAVS dependent signaling pathways mediated by cytoplasmic RLR and the TRIF/TICAM and MyD88 dependent signaling pathways mediated by the endosomal TLR (Matsumoto 2017). The combination of modulating or activating multiple signaling pathways can recruit additional immune effector cells and amplify the anti-tumor immune response. These nucleic acid ligands, such as TLR ligands and RLR ligands also promote antiviral responses including apoptosis and induction of immunity. The same antiviral immune system mechanisms when activated or stimulated are also effective in eliminating tumor cells by acting as an I/O in a peptide-I/O complex of the disclosure. In some embodiments, an RNA ligand acting as an I/O in the peptide-I/O complex of the disclosure activates RIG-I or MDA5, or an endosomal, RNA sensing TLR or RLR. In some cases, only the endosomal TLRs will be triggered. The molecular designs of the peptide-MDA5 I/O ligands of this disclosure can include any design element as described herein (e.g., for RIG-I), such as linker elements that may be stable, cleavable, hydrophobic or hydrophilic, RNA length and modifications, and cell penetrating modifications for, cytosolic delivery, and endosomal uptake or endosomal escape peptides.

RIG-I can recognize short, greater than or equal to 10 base pairs (Schmidt 2009), 5'-di or triphosphate dsRNAs with blunt 5' end and unmodified nucleotides most efficiently, independently of the RNA sequence (Uchikawa 2016). MDA5 recognizes dsRNA and is thought to bind the stem, rather than the end, and does not require specific RNA end structures (Wu 2012). MDA5 will bind 12mer dsRNA, and 15mers have been shown to stimulate ATP hydrolysis. As the RNA length grows, MDA5 filamentous oligomers are formed that have enhanced activity. Poly (I:C) without 5' triphosphate may activate MDA5, if 15-39 base pairs long it may activate MDA5 but not TLR3. TLR3 is also responsive to poly (I:C), preferably at least 40 base pairs long.

Conjugations, Fusions, and Processing

A peptide according to the present disclosure can be conjugated or fused to a peptide biological agent or other agent comprising amino acids (e.g., an antibody or antibody fragment, receptor or receptor fragment, ligand or ligand fragment, hormone or hormone fragment, growth factors and growth factor fragments, biological toxins and fragments thereof, or other active portion of a peptide) for use in the treatment of tumors. A peptide-I/O complex can be a peptide conjugated to an I/O by any mechanism described herein. For example, a peptide can be covalently conjugated to an I/O to form a peptide-I/O complex. A peptide can be chemically conjugated to an I/O to form a peptide-I/O complex. A peptide can also be noncovalently complexed by associated with an I/O or other portions of a molecule to bring the two agents together. A peptide and I/O can be expressed as a fusion protein to form a peptide-I/O fusion protein. For example, an antibody or fragment thereof or a cytokine and a peptide can be expressed as a fusion protein to form a peptide-I/O fusion protein. For example, in certain embodiments, a peptide as described herein can be fused to another molecule, such as an I/O that provides an anti-cancer activity. A peptide can be fused with an I/O through expression of a vector containing the sequence of the peptide with the sequence of the I/O. In various embodiments, the sequence of the peptide and the sequence of the I/O are expressed from the same Open Reading Frame (ORF). In various embodiments, the sequence of the peptide and the sequence of the I/O can comprise a contiguous sequence. Various vectors and recombinant systems known in the art can be employed to make such fusion peptides. The peptide and the I/O can each retain similar functional capabilities in the fusion peptide compared with their functional capabilities when expressed separately. In some embodiments, the I/O can be inactive or less active until it is cleaved, processed, or dissociated from the peptide of the peptide-I/O complex. Upon cleavage, processing, and/or dissociation from the peptide of the peptide-I/O complex, the active or more active drug may be referred to herein as the "cleaved I/O." Cleavage, processing, and/or dissociation of the I/O from the peptide-I/O complex can occur in the tumor microenvironment or intracellularly. In further aspects, the peptide-I/O complex is joined by a cleavable linker that is cleaved by low pH, reducing agents, glutathione, a protease, an enzyme, or is hydrolytically labile, thereby generating the cleaved I/O. In some aspects, the I/O portion of the cleaved I/O is chemically modified as compared to the I/O conjugated to the peptide. In other aspects, the I/O portion of cleaved I/O is not chemically modified as compared to the I/O conjugated to the peptide. In some aspects, the cleaved I/O has a different potency or activity after cleavage than the I/O within the peptide-I/O complex before cleavage. Similarly the activity of the peptide may be modified or degraded upon cleavage, processing or dissociation with the I/O in the tumor microenvironment or intracellularly. For example, the peptide in the peptide-I/O complex may be cleaved, removed, degraded, processed or dissociated by enzymes or chemically within the endosomes, lysosome, or after delivery to the cytoplasm. Cleavage could occur within the linker or within the peptide of this disclosure or within the I/O agent or at any location in the peptide-I/O complex. The peptide and I/O can also be complexed by formulation, such as in and/or on liposomes or nanoparticles.

Linkers

A peptide according to the present disclosure that homes, targets, migrates to, is retained by, accumulates in, penetrates, and/or binds to, is processed by, or is directed to the tumor or that penetrates or enters tumor cells can be attached to another moiety (e.g., an any I/O or any other active agent of the present disclosure), such as a small molecule, a second peptide, a protein, a cytokine, a cytokine-receptor chain complex, an antibody, an antibody fragment, an aptamer, polypeptide, polynucleotide, a double stranded (ds) DNA or RNA, a single stranded DNA or RNA, a microRNA, a siRNA, a panhandle RNA, a hairpin RNA, a cyclic dinucleotide, a fluorophore, a radioisotope, a radionuclide chelator, a polymer, a biopolymer, a fatty acid, an acyl adduct, a chemical linker, or sugar or other I/O or other active agent described herein through a linker, or directly in the absence of a linker.

A peptide can be directly attached to another molecule by a covalent attachment. For example, the peptide can be attached to a terminus of the amino acid sequence of a larger polypeptide or peptide molecule, or is attached to a side chain, such as the side chain of a lysine, serine, threonine, cysteine, tyrosine, aspartic acid, a non-natural amino acid residue, or glutamic acid residue. The peptide can also be attached to a polynucleotide, such as at the 3' end, the 5' end, or on one of the residues within the sequence, including a modified nucleotide base with a chemical handle such as an amine or sulfhydryl group. The peptide can also be attached to a cyclic dinucleotide, such as to a nitrogen, oxygen, carbon, or sulfur atom of the cyclic dinucleotide. The attachment can be via an amide bond, an ester bond, a thioester bond, a phosphoester bond, a phosphodiester bond, dithioanalogs of phosphodiester bonds, an ether bond, a carbamate bond, a carbonate bond, a carbon-nitrogen bond, a triazole, a macrocycle, an oxime bond, a hydrazone bond, a carbon-carbon single double or triple bond, a disulfide bond, or a thioether bond. The attachment can also be via a noncovalent complex or a reversible covalent bond, such as a phenylboronic acid complex with a cis-diol, or by ionic or hydrophobic interactions. In some embodiments, similar regions of the disclosed peptide(s) itself (such as a terminus of the amino acid sequence, an amino acid side chain, such as the side chain of a lysine, serine, threonine, cysteine, tyrosine, aspartic acid, a non-natural amino acid residue, or glutamic acid residue, via an amide bond, an ester bond, a thioester bond, a phosphoester bond, a phosphodiester bond, dithioanalogs of phosphodiester bonds, an ether bond, a carbamate bond, a carbonate bond, a carbon-nitrogen bond, a triazole, a macrocycle, an oxime bond, a hydrazone bond, a carbon-carbon single double or triple bond, a disulfide bond, a thioether bond, a noncovalent or reversible covalent linker, or any other linker as described herein) can be used to link other molecules or to link to any I/O described herein.

Attachment via a linker can involve incorporation of a linker moiety between the other molecule and the peptide. The peptide and the other molecule can both be covalently attached to the linker. The linker can be cleavable, stable, self-immolating, hydrophilic, or hydrophobic. A cleavable linker can cleave over seconds, minutes, hours, days, or weeks. A stable linker can never be cleaved, or can be cleaved very slowly, or can be degraded via catabolism. The linker can have at least two functional groups with one bonded to the peptide, the other bonded to the other molecule, and a linking portion between the two functional groups.

Non-limiting examples of the functional groups for attachment can include functional groups capable of forming an amide bond, an ester bond, a thioester bond, a phosphoester bond, a phosphodiester bond, dithioanalogs of phosphodiester bonds, an ether bond, a carbonate bond, a carbamate bond, a carbon-nitrogen bond, a triazole, a macrocycle, an oxime bond, a hydrazone bond, a carbon-carbon single, double, or triple bond, a disulfide bond, or a thioether bond. Non-limiting examples of functional groups capable of forming such bonds can include amino groups; carboxyl groups; hydroxyl groups; aldehyde groups; azide groups; alkyne and alkene groups; ketones; hydrazides; acid halides such as acid fluorides, chlorides, bromides, and iodides; acid anhydrides, including symmetrical, mixed, and cyclic anhydrides; carbonates; carbonyl functionalities bonded to leaving groups such as cyano, succinimidyl, and N-hydroxysuccinimidyl; maleimides; linkers containing maleimide groups that are designed to hydrolyze; maleimidocaproyl; MCC ([N-maleimidomethyl]cyclohexane-1-carboxylate); N-ethylmaleimide; maleimide alkane; mc-vc-PABC; DUBA (DuocarmycinhydroxyBenzamide-Azaindole linker); SMCC Succinimidyl-4-(N-maleimidomethyl) cyclohexane-1-carboxylate; SPDP (N-succinimidyl-3-(2-pyridyldithio) propionate); SPDB N-succinimidyl-4-(2-pyridyldithio) butanoate; sulfo-SPDB N-succinimidyl-4-(2-pyridyldithio)-2-sulfo butanoate; SPP N-succinimidyl 4-(2-pyridyldithio)pentanoate; a dithio-pyridylmaleimide (DTM); a hydroxylamine, a vinyl-halo group; haloacetamido groups; bromoacetamido; hydroxyl groups; sulfhydryl groups; and molecules possessing, for example, alkyl, alkenyl, alkynyl, allylic, or benzylic leaving groups, such as halides, mesylates, tosylates, triflates, epoxides, phosphate esters, sulfate esters, and besylates.

Non-limiting examples of the linking portion can include alkylene, alkenylene, alkynylene, polyether, such as polyethylene glycol (PEG), hydroxy carboxylic acids, oligoethylene glycol, polyester, polyamide, polyamino acids, zwitterionic polypeptide, polypeptide, polypeptide comprising G and S such as GGGS (SEQ ID NO: 1170), GGGSGGGS (SEQ ID NO: 1171), $(GGGS)_x$ (SEQ ID NO: 1172) where x=1-10, polypeptides comprising Pro, Ala, and Ser, cleavable peptides, valine-citrulline (Val-Cit) (SEQ ID NO: 1142), Phe-Lys (SEQ ID NO: 1143), Val-Lys (SEQ ID NO: 1140), Val-Ala (SEQ ID NO: 1139), Val-Lys (SEQ ID NO: 1140), Val-Arg (SEQ ID NO: 1141), Met-Lys (SEQ ID NO: 1144), Asn-Lys (SEQ ID NO: 1145), Ile-Pro (SEQ ID NO: 1146), Gly-Ile (SEQ ID NO: 1147), Gly-Leu (SEQ ID NO: 1148), Gly-Tyr (SEQ ID NO: 1149), Met-Ile (SEQ ID NO: 1151), Ala-Ile (SEQ ID NO: 1152), Pro-Ile (SEQ ID NO: 1153), Glu-Glu, Glu-Gly, Gly-Phe-Leu-Gly (SEQ ID NO: 1497), any peptides of SEQ ID NO: 1139-SEQ ID NO: 1161, SEQ ID NO: 1360-SEQ ID NO: 1363 and SEQ ID NO: 1365 other peptide linkers as given in Doronina et al., 2008, a linker cleavable by glucuronidases, such as beta glucuronidase, a linker cleavable by a cathepsin or by cathepsin B, D, E, H, L, S, C, K, O, F, V, X, or W, a linker cleavable by matrix metalloproteases such as MMP-1, 2, 7, 9, or 13, a linker cleavable by hyaluronidase, Val-Cit-p-aminobenzyloxycarbonyl, glucuronide-MABC, aminobenzylcarbamates, D-amino acids, and polyamine, any of which being unsubstituted or substituted with any number of substituents, such as halogens, hydroxyl groups, sulfhydryl groups, amino groups, nitro groups, nitroso groups, cyano groups, azido groups, sulfoxide groups, sulfone groups, sulfonamide groups, carboxyl groups, carboxaldehyde groups, imine groups, alkyl groups, halo-alkyl groups, alkenyl groups, halo-alkenyl groups, alkynyl groups, halo-alkynyl groups, alkoxy groups, aryl groups, aryloxy groups, aralkyl groups, arylalkoxy groups, heterocyclyl groups, acyl groups, acyloxy groups, carbamate groups, amide groups, urethane groups, epoxides, charged groups, zwitterionic groups, and ester groups. Other non-limiting examples of reactions to link molecules together include click chemistry, copper-free click chemistry, HIPS ligation, Staudinger ligation, and hydrazine-iso-Pictet-Spengler.

A peptide and I/O can be conjugated via a linker can be described with the formula Peptide-A-B-C. A can be a stable amide link to an amine or carboxylic acid on the peptide and the linker, and can be achieved via a tetrafluorophenyl (TFP) ester, an NHS ester, or an ATT group (thiazolidine-thione). A can be a stable carbamate linker such as that formed by reacting an amine on the peptide with an imidazole carbamate active intermediate formed by reaction of CDI with a hydroxyl on the linker. A can be a stable secondary amine linkage such as that formed by reductive alkylation of the amine on the peptide with an aldehyde or ketone group on the linker. A can be a stable thioether linker formed using a maleimide or bromoacetamide in the linker with a thiol in the peptide, a triazole linker, a stable oxime linker, or a oxacarboline linker. B can comprise $(-CH2-)_x$-, with or without branching a short PEG $(-CH_2CH_2O-)_x$ (x is 1-20), or a short polypeptide such as GGGSGGGS (SEQ ID NO: 1171), Val-Ala (SEQ ID NO: 1139), Val-Cit (SEQ ID NO: 1142), Val-Cit-PABC, Gly-Ile (SEQ ID NO: 1147), Gly-Leu (SEQ ID NO: 1148), other spacers, or no spacer. C can be a disulfide bond, an amide bond, carbamate, a carbon-carbon single double or triple bond, or an ester bond to a thiol, an amine, a hydroxyl, or carboxylic acid on the I/O. C can be a thioether formed between a maleimide on the linker and a sulfhydryl on the I/O, a secondary or tertiary amine, a carbamate, or other stable bond. In some embodiments, C can refer to the "cleavable" or "stable" part of the linker. In other embodiments, A and/or B can also be the "cleavable" or stable part. In some embodiments, A can be amide, carbamate, thioether via maleimide or bromoacetamide, triazole, oxime, or oxacarboline. Any linker chemistry described in "Current ADC Linker Chemistry," Jain et al., Pharm Res, 2015 DOI 10.1007/s11095-015-1657-7 or in Bioconjugate Techniques, $3^{rd}$ edition, by Greg Hermanson can be used.

In some embodiments, a peptide conjugate can have stable linkers. A peptide of the disclosure can be expressed recombinantly or chemically synthesized. The peptide can be conjugated to a detectable agent, active agent, or an I/O via a stable linker, such as an amide linkage or a carbamate linkage. The peptide can be conjugated to a detectable agent, active agent, or an I/O via a stable linker, such as an amide bond using standard 1-ethyl-3-(3-dimethylaminopropyl)carbodiimide (EDC) or dicyclohexylcarbodiimide (DCC) based chemistry, or thionyl chloride or phosphorous chloride-based bioconjugation chemistries.

The resulting peptide conjugate can be administered to a human or animal subcutaneously, intravenously, intramuscularly, intradermally, orally, or injected or applied directly into a tumor or tumor microenvironment (intratumorally) or organ to treat disease. The peptide can or may not be specifically cleaved from the detectable agent, active agent, or the I/O via a targeted mechanism. The peptide can be degraded by mechanisms such as catabolism, releasing a drug that is modified or not modified from its "native" or initial form (Antibody-Drug Conjugates: Design, Formulation, and Physicochemical Stability, Singh, Luisi, and Pak. Pharm Res (2015) 32:3541-3571). The peptide drug conjugate exerts its pharmacological activity while still intact, or while partially or fully degraded, metabolized, or catabolized. The peptide conjugate can be designed such that the I/O is only active after cleavage or is more active after cleavage, or the peptide conjugate can be designed such that the I/O is active while conjugated to the peptide.

The rate of cleavage around a cleavable bond can be varied by varying the local environment around the bond, including carbon length (—CH2-)x, steric hindrance or lack thereof (including adjacent side groups such as methyl, ethyl, cyclic as well as adjacent spacers such as peptidic spacers, which can comprise amino acids such as G, A, or S), hydrophilicity (such as adding hydroxyl, carboxylic acid, or oligoethylene glycol groups), or hydrophobicity (such as adding fluorenes, hydrocarbon groups, or fatty tails), adding electron withdrawing or electron donating groups. In some embodiments, cleavage rate can be affected by local pH.

Cleavage can occur by different mechanisms and at different locations in the body or in the cell. Cleavage can occur at higher rates in lower pH environments, such as the lower pH in an endosome, a lysosome, or diseased tissues such as tumors. Some linkages cleavable by lower pHs include esters, carbamates, carbonates, hydrazones, oximes, and reversible covalent complexes between phenylboronic acids and cis-diols. Cleavage can occur due to reducing environments or disulfide exchange. The cytosol, endosomes, lysosomes, tumor microenvironments, and the cell surface can all be reducing or provide agents (such as glutathione, albumin, or cysteine residues) for disulfide exchange. Cleavage can occur enzymatically, such as by esterases, cathepsins, matrix metalloproteinases, pepsinogen, gelatinase, elastase, trypsin, plasminogen activators, glucuronidases, or hyaluronidase. In some embodiments, the cleavable linker may be cleaved only, or preferentially, upon delivery to a tumor microenvironment, a tumor cell surface, a cellular cytoplasm, or an intracellular compartment such as an endosome or lysosome. These enzymes can be present at higher levels in the tumor microenvironment, on the cell surface, in the endosomal-lysosomal pathway, or in the cytosol. A self-immolating group such as pABC can be included to cause release of a free unmodified drug upon cleavage (Antibody-Drug Conjugates: Design, Formulation, and Physicochemical Stability, Singh, Luisi, and Pak. Pharm Res (2015) 32:3541-3571). The rate of cleavage of the linker can be tuned according to the residency time of the conjugate or peptide-I/O complex in the tumor. For example, when a peptide or peptide-I/O complex is cleared from the tumor relatively quickly, the linker can be tuned to rapidly cleave. In contrast, for example, when a peptide or peptide-I/O complex has a longer residence time in the tumor, a slower cleavage rate can allow for extended delivery of an I/O. This can be important when the peptide or peptide-I/O complex is used to deliver a drug or I/O to the tumor.

Non-limiting examples of linkers include:

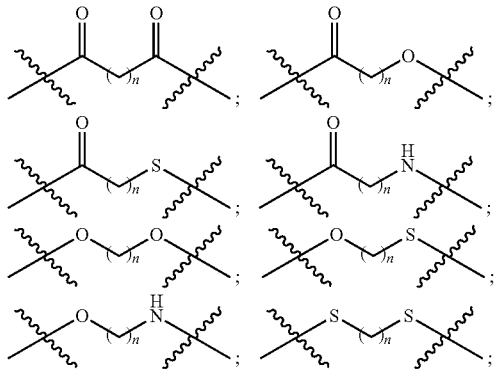

-continued

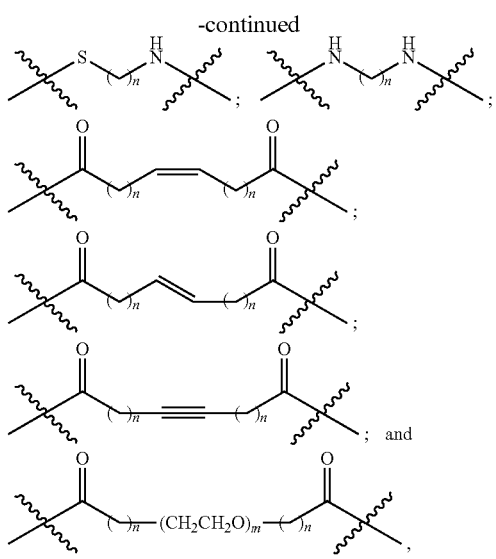

wherein each n is independently 0 to about 1,000; 1 to about 1,000; 0 to about 500; 1 to about 500; 0 to about 250; 1 to about 250; 0 to about 200; 1 to about 200; 0 to about 150; 1 to about 150; 0 to about 100; 1 to about 100; 0 to about 50; 1 to about 50; 0 to about 40; 1 to about 40; 0 to about 30; 1 to about 30; 0 to about 25; 1 to about 25; 0 to about 20; 1 to about 20; 0 to about 15; 1 to about 15; 0 to about 10; 1 to about 10; 0 to about 5; or 1 to about 5. In some embodiments, each n is independently 0, about 1, about 2, about 3, about 4, about 5, about 6, about 7, about 8, about 9, about 10, about 11, about 12, about 13, about 14, about 15, about 16, about 17, about 18, about 19, about 20, about 21, about 22, about 23, about 24, about 25, about 26, about 27, about 28, about 29, about 30, about 31, about 32, about 33, about 34, about 35, about 36, about 37, about 38, about 39, about 40, about 41, about 42, about 43, about 44, about 45, about 46, about 47, about 48, about 49, about 50, or any linker as disclosed in Jain, N., Pharm Res. 32(11): 3526-40 (2015) or Ducry, L., Antibody Drug Conjugates (2013). In some embodiments, m is 1 to about 1,000; 1 to about 500; 1 to about 250; 1 to about 200; 1 to about 150; 1 to about 100; 1 to about 50; 1 to about 40; 1 to about 30; 1 to about 25; 1 to about 20; 1 to about 15; 1 to about 10; or 1 to about 5. In some embodiments, m is 0, about 1, about 2, about 3, about 4, about 5, about 6, about 7, about 8, about 9, about 10, about 11, about 12, about 13, about 14, about 15, about 16, about 17, about 18, about 19, about 20, about 21, about 22, about 23, about 24, about 25, about 26, about 27, about 28, about 29, about 30, about 31, about 32, about 33, about 34, about 35, about 36, about 37, about 38, about 39, about 40, about 41, about 42, about 43, about 44, about 45, about 46, about 47, about 48, about 49, or about 50.

In some embodiments, the linker can release the I/O in an unmodified form. In other embodiments, the I/O can be released with chemical modification. In still other embodiments, catabolism can release the I/O still linked to parts of the linker and/or peptide.

A cleavable linker can release an I/O from the peptide. For example, an I/O in a conjugate form with the peptide (i.e., a peptide-I/O complex) may not be initially active, but upon release from the conjugate after targeting to the tumor, the I/O can become active, such as by binding the peptide to the 5' triphosphate region of an RNA or other parts of the I/O that are essential for function. This can reduce side-effects from I/Os in parts of the body that are not the tumor. Alternatively, a stable linker can still permit release of an active cleavage product after catabolism in a cell. The I/O can alternatively be active when it is still conjugated to the peptide in a peptide-I/O complex, or the peptide can serve to increase the local concentration of the I/O within the tumor microenvironment, on the cell surface, or in the cytosol In some embodiments, a peptide can be conjugated to an I/O by common techniques known in the art, such those described in Bioconjugate Techniques by Greg T. Hermanson (2013).

The choice of linker can be made based on the target for an I/O of this disclosure. For example, cleavable disulfide linkages can be utilized when the I/O is being targeted to an endosomal/lysosomal pathway or the cytoplasm, in which the linker can be reduced. Cleavable hydrazone or ester linkages or boronic acid diol complexes can be utilized when the I/O is being targeted to an endosomal/lysosomal pathway or the tumor microenvironment in general, where the linker can cleaved as a result of low pH. Linkers can also be enzyme cleavable (e.g., by cathepsins or MMPs) wherein the I/O is being targeted to an endosomal/lysosomal pathway, extracellular cell surfaces, the tumor microenvironment in general, or the cytoplasm.

In addition, the peptide-I/O complex can be designed with different ratios. For example, the I/O can have multiple peptides complexed to it. For example, multiple peptides can be fused with an IL-15 hyperagonist in a chain at the N- or C-terminus with spacer(s) in between or at multiple locations of the agonist. In another example, multiple I/Os can be complexed with one peptide, such as on the N-terminus and a Lys residue of the peptide. Various ratios of I/O and peptide can also be achieved by formulation. For example, in some embodiments the I/O to peptide ratio in a peptide-I/O complex can be from 0.05:1 to 20:1.

Peptide Stability

A peptide of the present disclosure can be stable in various biological conditions. For example, any peptide of SEQ ID NO: 1-SEQ ID NO: 1134, SEQ ID NO: 1243-SEQ ID NO: 1262, or SEQ ID NO: 1263-SEQ ID NO: 1316 can exhibit resistance to reducing agents, proteases, oxidative conditions, or acidic conditions.

In some cases, biologic molecules (such as peptides and proteins) can provide therapeutic functions, but such therapeutic functions are decreased or impeded by instability caused by the in vivo environment. (Moroz et al. Adv Drug Deliv Rev 101:108-21 (2016), Mitragotri et al. Nat Rev Drug Discov 13(9):655-72 (2014), Bruno et al. Ther Deliv (11):1443-67 (2013), Sinha et al. Crit Rev Ther Drug Carrier Syst. 24(1):63-92 (2007), Hamman et al. BioDrugs 19(3): 165-77 (2005)). For instance, the GI tract can contain a region of low pH (e.g. pH~1), a reducing environment, or a protease-rich environment that can degrade peptides and proteins. Proteolytic activity in other areas of the body, such as the mouth, eye, lung, intranasal cavity, joint, skin, vaginal tract, mucous membranes, tumor tissue, and serum, can also be an obstacle to the delivery of functionally active peptides and polypeptides. Additionally, the half-life of peptides in serum can be very short, in part due to proteases, such that the peptide can be degraded too quickly to have a lasting therapeutic effect when administering reasonable dosing regimens. Likewise, proteolytic activity in cellular compartments such as lysosomes, endosomes, or Golgi apparatus, and reduction activity in lysosomes, endosomes, or Golgi apparatus and the cytosol can degrade peptides and proteins such that they may be unable to provide a therapeutic function on intracellular targets. Therefore, peptides that are resistant to reducing agents, proteases, and low pH may be able to provide enhanced therapeutic effects or enhance the therapeutic efficacy of co-formulated or conjugated I/O in vivo.

Additionally, oral delivery of drugs can be desirable in order to target certain areas of the body (e.g., disease in the GI tract such as colon cancer) despite the obstacles to the delivery of functionally active peptides and polypeptides presented by this method of administration. Oral delivery of drugs can increase compliance by providing a dosage form that is more convenient for patients to take as compared to parenteral delivery. Oral delivery can be useful in treatment regimens that have a large therapeutic window. Therefore, peptides that are resistant to reducing agents, proteases, and low pH can allow for oral delivery of peptides without nullifying their therapeutic function. For example, certain small molecule I/Os (e.g., STING ligands or RIG-I ligand I/Os acting as STING or RIG-I agonist) can be improved by conjugation to any peptide of the present disclosure (to make a peptide-I/O complex) and are, thus, optimized for oral delivery.

Peptide Resistance to Reducing Agents.

In some embodiments, a peptide of the present disclosure can be reduction resistant. Peptides of this disclosure can contain one or more cysteines, which can participate in disulfide bridges that can be integral to preserving the folded state of the peptide. Exposure of peptides to biological environments with reducing agents can result in unfolding of the peptide and loss of functionality and bioactivity. For example, glutathione (GSH) is a reducing agent that can be present in many areas of the body and in cells, and can reduce disulfide bonds. As another example, a peptide can become reduced upon cellular internalization during trafficking of a peptide across the gastrointestinal epithelium after oral administration A peptide can become reduced upon exposure to various parts of the GI tract. The GI tract can be a reducing environment, which can inhibit the ability of therapeutic molecules with disulfide bonds to have optimal therapeutic efficacy, due to reduction of the disulfide bonds. A peptide can also be reduced upon entry into a cell, such as after internalization by endosomes or lysosomes or into the cytosol, or other cellular compartments. Reduction of the disulfide bonds and unfolding of the peptide can lead to loss of functionality or affect key pharmacokinetic parameters such as bioavailability, peak plasma concentration, bioactivity, and half-life. Reduction of the disulfide bonds can also lead to increased susceptibility of the peptide to subsequent degradation by proteases, resulting in rapid loss of intact peptide after administration. In some embodiments, a peptide that is resistant to reduction can remain intact and can impart a functional activity for a longer period of time in various compartments of the body and in cells, as compared to a peptide that is more readily reduced.

In certain embodiments, the peptides of this disclosure can be analyzed for the characteristic of resistance to reducing agents to identify stable peptides. In some embodiments, the peptides of this disclosure can remain intact after being exposed to different molarities of reducing agents such as 0.00001M-0.0001M, 0.0001M-0.001M, 0.001M-0.01M, 0.01 M-0.05 M, 0.05 M-0.1 M, for greater 15 minutes or more. In some embodiments, the reducing agent used to determine peptide stability can be dithiothreitol (DTT), Tris(2-carboxyethyl)phosphine HCl (TCEP), 2-Mercaptoethanol, (reduced) glutathione (GSH), or any combination thereof. In some embodiments, at least 5%-10%, at least 10%-20%, at least 20%-30%, at least 30%-40%, at least 40%-50%, at least 50%-60%, at least 60%-70%, at least 70%-80%, at least 80%-90%, or at least 90%-100% of the peptide remains intact after exposure to a reducing agent.

Peptide Resistance to Proteases.

In some embodiments, a peptide of the present disclosure can be resistant to protease degradation. The stability of peptides of this disclosure can be determined by resistance to degradation by proteases. Proteases, also referred to as peptidases or proteinases, can be enzymes that can degrade peptides and proteins by breaking bonds between adjacent amino acids. Families of proteases with specificity for targeting specific amino acids can include serine proteases, cysteine proteases, threonine proteases, aspartic proteases, glutamic proteases, esterases, serum proteases, and asparagine proteases. Additionally, metalloproteases, matrix metalloproteases, elastase, carboxypeptidases, Cytochrome P450 enzymes, and cathepsins can also digest peptides and proteins. Proteases can be present at high concentration in blood, in mucous membranes, lungs, skin, the GI tract, the mouth, nose, eye, and in compartments of the cell. Misregulation of proteases can also be present in various diseases such as rheumatoid arthritis and other immune disorders and cancer. Degradation by proteases can reduce bioavailability, biodistribution, half-life, and bioactivity of therapeutic molecules such that they are unable to perform their therapeutic function. In some embodiments, peptides that are resistant to proteases can better provide therapeutic activity at reasonably tolerated concentrations in vivo.

In some embodiments, peptides of this disclosure can resist degradation by any class of protease. In certain embodiments, peptides of this disclosure resist degradation by pepsin (which can be found in the stomach), trypsin (which can be found in the duodenum), serum proteases, or any combination thereof. In certain embodiments, peptides of this disclosure can resist degradation by lung proteases (e.g., serine, cysteinyl, and aspartyl proteases, metalloproteases, neutrophil elastase, alpha-1 antitrypsin, secretory leucoprotease inhibitor, elafin), or any combination thereof. In some embodiments, the proteases used to determine peptide stability can be pepsin, trypsin, chymotrypsin, or any combination thereof. In some embodiments, at least 5%-10%, at least 10%-20%, at least 20%-30%, at least 30%-40%, at least 40%-50%, at least 50%-60%, at least 60%-70%, at least 70%-80%, at least 80%-90%, or at least 90%-100% of the peptide remains intact after exposure to a protease.

Peptide Stability in Acidic Conditions.

Peptides of this disclosure can be administered in biological environments that are acidic. For example, after oral administration, peptides can experience acidic environmental conditions in the gastric fluids of the stomach and gastrointestinal (GI) tract. The pH of the stomach can range from ~1-4 and the pH of the GI tract ranges from acidic to normal physiological pH descending from the upper GI tract to the colon. In addition, the vagina, late endosomes, lysosomes, and the tumor microenvironment can also have acidic pH values, such as less than pH 7.4. These acidic conditions can lead to denaturation of peptides and proteins into unfolded states. Unfolding of peptides and proteins can lead to increased susceptibility to subsequent digestion by other enzymes as well as loss of biological activity of the peptide.

In certain embodiments, the peptides of this disclosure can resist denaturation and degradation in acidic conditions and in buffers, which simulate acidic conditions. In certain embodiments, peptides of this disclosure can resist denaturation or degradation in buffer with a pH less than 1, a pH less than 2, a pH less than 3, a pH less than 4, a pH less than 5, a pH less than 6, a pH less than 7, or a pH less than 8. In some embodiments, peptides of this disclosure remain intact at a pH of 1-3. In certain embodiments, at least 5%-10%, at least 10%-20%, at least 20%-30%, at least 30%-40%, at least 40%-50%, at least 50%-60%, at least 60%-70%, at least 70%-80%, at least 80%-90%, or at least 90%-100% of the peptide remains intact after exposure to a buffer with a pH less than 1, a pH less than 2, a pH less than 3, a pH less than 4, a pH less than 5, a pH less than 6, a pH less than 7, or a pH less than 8. In other embodiments, at least 5%-10%, at least 10%-20%, at least 20%-30%, at least 30%-40%, at least 40%-50%, at least 50%-60%, at least 60%-70%, at least 70%-80%, at least 80%-90%, or at least 90%400% of the peptide remains intact after exposure to a buffer with a pH of 1-3. In other embodiments, the peptides of this disclosure can be resistant to denaturation or degradation in simulated gastric fluid (pH 1-2). In some embodiments, at least 5-10%, at least 10%-20%, at least 20%-30%, at least 30%-40%, at least 40%-50%, at least 50%-60%, at least 60%-70%, at least 70%-80%, at least 80%-90%, or at least 90-100% of the peptide remains intact after exposure to simulated gastric fluid. In some embodiments, low pH solutions such as simulated gastric fluid or citrate buffers can be used to determine peptide stability.

Peptide Stability at High Temperatures.

In some embodiments, the peptides of the present disclosure are resistant to an elevated temperature. Peptides of this disclosure can be administered in biological environments with high temperatures. For example, after oral administration, peptides can experience high temperatures in the body. Body temperature can range from 36° C. to 40° C. High temperatures can lead to denaturation of peptides and proteins into unfolded states. Unfolding of peptides and proteins can lead to increased susceptibility to subsequent digestion by other enzymes as well as loss of biological activity of the peptide. In some embodiments, a peptide of this disclosure can remain intact at temperatures from 25° C. to 100° C. High temperatures can lead to faster degradation of peptides. Stability at a higher temperature can allow for storage of the peptide in tropical environments or areas where access to refrigeration is limited. In certain embodiments, 5%-100% of the peptide can remain intact after exposure to 25° C. for 6 months to 5 years. 5%-100% of a peptide can remain intact after exposure to 70° C. for 15 minutes to 1 hour. 5%-100% of a peptide can remain intact after exposure to 100° C. for 15 minutes to 1 hour. In other embodiments, at least 5%-10%, at least 10%-20%, at least 20%-30%, at least 30%-40%, at least 40%-50%, at least 50%-60%, at least 60%-70%, at least 70%-80%, at least 80%-90%, or at least 90%-100% of the peptide remains intact after exposure to 25° C. for 6 months to 5 years. In other embodiments, at least 5%-10%, at least 10%-20%, at least 20%-30%, at least 30%-40%, at least 40%-50%, at least 50%-60%, at least 60%-70%, at least 70%-80%, at least 80%-90%, or at least 90%-100% of the peptide remains intact after exposure to 70° C. for 15 minutes to 1 hour. In other embodiments, at least 5%-10%, at least 10%-20%, at least 20%-30%, at least 30%-40%, at least 40%-50%, at least 50%-60%, at least 60%-70%, at least 70%-80%, at least 80%-90%, or at least 90%-100% of the peptide remains intact after exposure to 100° C. for 15 minutes to 1 hour.

Pharmacokinetics of Peptides

The pharmacokinetics of any of the peptides of this disclosure can be determined after administration of the peptide via different routes of administration. For example, the pharmacokinetic parameters of a peptide of this disclosure can be quantified after intravenous, subcutaneous, intramuscular, rectal, aerosol, parenteral, ophthalmic, pulmonary, transdermal, vaginal, optic, nasal, oral, sublingual, inhalation, dermal, intrathecal, intranasal, intra-tumoral, intra-articular, peritoneal, buccal, synovial, intra-organ, or topical administration. Peptides of the present disclosure can be analyzed by using tracking agents such as radiolabels or fluorophores. For example, a radiolabeled peptide of this disclosure can be administered via various routes of administration. Peptide concentration or dose recovery in various biological samples such as plasma, urine, feces, any organ, skin, muscle, and other tissues can be determined using a range of methods including HPLC, fluorescence detection techniques (TECAN quantification, flow cytometry, iVIS), or liquid scintillation counting.

The methods and compositions described herein can relate to pharmacokinetics of peptide administration via any route to a subject. Pharmacokinetics can be described using methods and models, for example, compartmental models or noncompartmental methods. Compartmental models include but are not limited to monocompartmental model, the two compartmental model, the multicompartmental model or the like. Models can be divided into different compartments and can be described by the corresponding scheme. For example, one scheme is the absorption, distribution, metabolism and excretion (ADME) scheme. For another example, another scheme is the liberation, absorption, distribution, metabolism and excretion (LADME) scheme. In some aspects, metabolism and excretion can be grouped into one compartment referred to as the elimination compartment. For example, liberation can include liberation of the active portion of the composition from the delivery system, absorption includes absorption of the active portion of the composition by the subject, distribution includes distribution of the composition through the blood plasma and to different tissues, metabolism, which includes metabolism or inactivation of the composition and finally excretion, which includes excretion or elimination of the composition or the products of metabolism of the composition. Compositions administered intravenously to a subject can be subject to multiphasic pharmacokinetic profiles, which can include but are not limited to aspects of tissue distribution and metabolism/excretion. As such, the decrease in plasma or serum concentration of the composition is often biphasic, including, for example an alpha phase and a beta phase, occasionally a gamma, delta or other phase is observed Pharmacokinetics includes determining at least one parameter associated with administration of a peptide to a subject. In some aspects, parameters include at least the dose (D), dosing interval (τ), area under curve (AUC), maximum concentration ($C_{max}$), minimum concentration reached before a subsequent dose is administered ($C_{min}$), minimum time ($T_{min}$), maximum time to reach Cmax ($T_{max}$), volume of distribution ($V_d$), steady-state volume of distribution ($V_{ss}$), back-extrapolated concentration at time 0 ($C_0$), steady state concentration ($C_{ss}$), elimination rate constant ($k_e$), infusion rate ($k_{in}$), clearance (CL), bioavailability (f), fluctuation (% PTF) and elimination half-life ($t_{1/2}$).

In certain embodiments, the peptides of any of SEQ ID NO: 1-SEQ ID NO: 1134, SEQ ID NO: 1243-SEQ ID NO: 1262, or SEQ ID NO: 1263-SEQ ID NO: 1316 exhibit optimal pharmacokinetic parameters after oral administration. In other embodiments, the peptides of any of SEQ ID NO: 1-SEQ ID NO: 1134, SEQ ID NO: 1243-SEQ ID NO: 1262, or SEQ ID NO: 1263-SEQ ID NO: 1316 exhibit optimal pharmacokinetic parameters after any route of administration, such as oral administration, inhalation, intranasal administration, topical administration, parenteral administration, intravenous administration, subcutaneous administration, intra-tumoral, intra-articular administration, intramuscular administration, intraperitoneal administration, transdermal administration, dermal administration, or any combination thereof.

In some embodiments any peptide of SEQ ID NO: 1-SEQ ID NO: 1134, SEQ ID NO: 1243-SEQ ID NO: 1262, or SEQ ID NO: 1263-SEQ ID NO: 1316 exhibits an average $T_{max}$ of 0.5-12 hours, or 1-48 hours at which the $C_{max}$ is reached, an average bioavailability in serum of 0.1%-10% in the subject after administering the peptide to the subject by an oral route, an average bioavailability in serum of less than 0.1% after oral administration to a subject for delivery to the GI tract, an average bioavailability in serum of 10-100% after parenteral administration, an average $t_{1/2}$ of 0.1 hours-168 hours, or 0.25 hours-48 hours in a subject after administering the peptide to the subject, an average clearance (CL) of 0.5-100 L/hour or 0.5-50 L/hour of the peptide after administering the peptide to a subject, an average volume of distribution ($V_d$) of 200-20,000 mL in the subject after systemically administering the peptide to the subject, or optionally no systemic uptake, any combination thereof Methods of Manufacture Various expression vector/host systems can be utilized for the production of the recombinant expression of peptides, peptide-I/O complexes, or I/Os described herein. Non-limiting examples of such systems include microorganisms such as bacteria transformed with recombinant bacteriophage DNA, plasmid DNA or cosmid DNA expression vectors containing a nucleic acid sequence encoding peptides or peptide fusion proteins/chimeric proteins or proteins described herein, yeast transformed with recombinant yeast expression vectors containing the aforementioned nucleic acid sequence, insect cell systems infected with recombinant virus expression vectors (e.g., baculovirus) containing the aforementioned nucleic acid sequence, plant cell systems infected with recombinant virus expression vectors (e.g., cauliflower mosaic virus (CaMV), tobacco mosaic virus (TMV) or transformed with recombinant plasmid expression vectors (e.g., Ti plasmid) containing the aforementioned nucleic acid sequence, or animal cell systems infected with recombinant virus expression vectors (e.g., adenovirus, vaccinia virus) including cell lines engineered to contain multiple copies of the aforementioned nucleic acid sequence, either stably amplified (e.g., CHO/dhfr, CHO/glutamine synthetase) or unstably amplified in double-minute chromosomes (e.g., murine cell lines). Disulfide bond formation and folding of the peptide could occur during expression or after expression or both.

A host cell can be adapted to express one or more peptides or proteins, or peptide-I/O complexes, described herein. The host cells can be prokaryotic or eukaryotic, and includes insect cells. In some cases, host cells are capable of modulating the expression of the inserted sequences, or modifying and processing the gene or protein product in the specific fashion desired. For example, expression from certain promoters can be elevated in the presence of certain inducers (e.g., zinc and cadmium ions for metallothionine promoters). In some cases, modifications (e.g., phosphorylation and glycosylation) and processing (e.g., cleavage) of peptide products can be important for the function of the peptide. Host cells can have characteristic and specific mechanisms for the post-translational processing and modification of a peptide. In some cases, the host cells used to express the peptides secretes minimal amounts of proteolytic enzymes.

In the case of cell- or viral-based samples, organisms can be treated prior to purification to preserve and/or release a target polypeptide. In some embodiments, the cells are fixed using a fixing agent. In some embodiments, the cells are lysed. The cellular material can be treated in a manner that does not disrupt a significant proportion of cells, but which removes proteins from the surface of the cellular material, and/or from the interstices between cells. For example, cellular material can be soaked in a liquid buffer or, in the case of plant material, can be subjected to a vacuum, in order to remove proteins located in the intercellular spaces and/or in the plant cell wall. If the cellular material is a microorganism, proteins can be extracted from the microorganism culture medium. Alternatively, the peptides can be packed in inclusion bodies. The inclusion bodies can further be separated from the cellular components in the medium. In some embodiments, the cells are not disrupted. A cellular or viral peptide that is presented by a cell or virus can be used for the attachment and/or purification of intact cells or viral particles. Alternatively the peptide or protein can be secreted from cells into the culture media. In addition to recombinant systems, Peptides and polypeptides can also be synthesized in a cell-free system using a variety of known techniques employed in protein and peptide synthesis.

In some cases, a host cell produces a peptide that has an attachment point for a drug. An attachment point could comprise a lysine residue, an N-terminus, a cysteine residue, a cysteine disulfide bond, or a non-natural amino acid. A non-natural amino acid can be incorporated by synthetic or recombinant techniques.

The peptide can also be produced synthetically, such as by solid-phase peptide synthesis, or solution-phase peptide synthesis. Peptide synthesis can be performed by fluorenylmethyloxycarbonyl (Fmoc) chemistry, for example according to the Fmoc solid phase peptide synthesis method ("Fmoc solid phase peptide synthesis, a practical approach," edited by W. C. Chan and P. D. White, Oxford University Press, 2000), or by butyloxycarbonyl (Boc) chemistry. The peptide can be folded (such as formation of disulfide bonds) during synthesis or after synthesis or both and can be executed by methods known in the art, such as incubation of the peptide at a mildly basic pH in the presence of a redox pair such as reduced and oxidized cysteine or glutathione, either after cleavage and protecting group removal and purification, or while still on the resin. Peptide fragments can be produced enzymatically or synthetically or recombinantly and then joined together synthetically, recombinantly, or via an enzyme.

In other aspects, the peptides of the present disclosure can be prepared by conventional solution phase peptide synthesis.

RNA polynucleotides can also be produced using the methods described in U.S. Pat. No. 9,279,149, and is incorporated herein by reference. In some embodiments, RNA polynucleotides are synthesized by enzymatic/PCR methods. For example, RNA polynucleotides can be synthesized using an enzyme, such as a nucleotidyl transferase (e.g., E. coli poly(A) polymerase or E. coli poly(U) polymerase), which can add RNA nucleotides to the 3' end. Alternatively, E. coli poly(U) polymerase can be used. A 3' unblocked reversible terminator ribonucleotide triphosphates (rNTPs) can be used during polynucleotide synthesis. Alternatively, 3'blocked, 2'blocked, or 2'-3' blocked rNTPs can be used alongside either enzyme described above. RNA polynucleotides can also be synthesized using standard solid-phase synthesis techniques and phosphoramidite-based methods. RNA polynucleotides of the present disclosure can be prepared by conventional solid phase oligonucleotide synthesis. For example any method of solid-phase synthesis can be employed including, but not limited to methods described, as shown at https://www.atdbio.com/content/17/Solid-phase-oligonucleotide-synthesis, and in Albericio (Solid-Phase Synthesis: A practical guide, CRC Press, 2000), Lambert et al. (Oligonucleotide Synthesis: Solid-Phase Synthesis, DNA, DNA Sequencing, RNA, Small Interfering RNA, Nucleoside, Nucleic Acid, Nucleotide, Phosphoramidite, Sense, Betascript Publishing, 2010), and Guzaev, A. P. et al. (Current Protocols in Nucleic Acid Chemistry. 2013; 53:3.1:3.1.1-3.1.60.), each of which are incorporated herein by reference. Solid supports such as CPG or polystyrene can be used. Phosphoramidite chemistry can be used by cycling through the following steps: detritylation of the support-bound 3'-nucleoside, activation and coupling, capping, and oxidation. At the end of synthesis, the protected nucleotide can be cleaved from the support and then deprotected. Protecting groups used in solid-phase synthesis of RNA polynucleotides can include t-butyldimethylsilyl (TBDMS) or tri-iso-propylsilyloxymethyl (TOM), The RNA polynucleotides can have a modified backbone to enhance stability. Additionally, non-natural or modified bases can be used to serve as unique functional handles for subsequent chemical conjugation. In some embodiments, modification of the 5' and or 3' ends of the RNA can be performed to result in desired functional groups, stability, or activity. in some embodiments, the functional handles comprise modified bases including one or more modified uridine, modified guanosine, modified cytidine, or modified adenosine base of the RNA. An example of such modified base is a uridine with an extended amine.

An I/O of this disclosure can be made synthetically, recombinantly, or by small molecule synthesis techniques. The peptides of this closure can be made synthetically or recombinantly. The peptide and I/O can be combined by organic synthesis techniques, by polypeptide fusion during recombinant expression, by enzymatic ligation, by formulation, or by other means.

Pharmaceutical Compositions of Peptides and Peptide-I/O Complexes

A pharmaceutical composition of the disclosure can be a combination of any peptide or peptide-I/O complex described herein, or a salt thereof, with other chemical components, such as carriers, stabilizers, diluents, dispersing agents, suspending agents, thickening agents, antioxidants, solubilizers, buffers, osmolytes, salts, surfactants, amino acids, encapsulating agents, bulking agents, cryoprotectants, and/or excipients. The pharmaceutical composition facilitates administration of a peptide or peptide-I/O complex described herein to an organism. Pharmaceutical compositions can be administered in therapeutically-effective amounts as pharmaceutical compositions by various forms and routes including, for example, intravenous, subcutaneous, intramuscular, rectal, aerosol, parenteral, ophthalmic, pulmonary, transdermal, vaginal, optic, nasal, oral, sublingual, inhalation, dermal, intrathecal, intranasal, intra-tumoral, intra-articular, topical administration, intra-organ, or a combination thereof. A pharmaceutical composition can be administered in a local or systemic manner, for example, via injection of the peptide described herein directly into an organ, optionally in a depot.

Parenteral injections can be formulated for bolus injection or continuous infusion. The pharmaceutical compositions can be in a form suitable for parenteral injection as a sterile suspension, solution or emulsion in oily or aqueous vehicles, and can contain formulatory agents such as suspending, stabilizing and/or dispersing agents. Pharmaceutical formulations for parenteral administration include aqueous solutions of a peptide described herein in water soluble form. Suspensions of peptides described herein can be prepared as oily injection suspensions. Suitable lipophilic solvents or vehicles include fatty oils such as sesame oil, or synthetic fatty acid esters, such as ethyl oleate or triglycerides, or liposomes. Aqueous injection suspensions can contain substances which increase the viscosity of the suspension, such as sodium carboxymethyl cellulose, sorbitol, or dextran. The suspension can also contain suitable stabilizers or agents which increase the solubility and/or reduces the aggregation of such peptides described herein to allow for the preparation of highly concentrated solutions. Alternatively, the peptides described herein can be lyophilized or in powder form for re-constitution with a suitable vehicle, e.g., sterile pyrogen-free water, before use. In some embodiments, a purified peptide is administered intravenously.

A peptide or peptide-I/O complex of the disclosure can be applied directly to an organ, or an organ tissue or cells, such as brain or brain tissue or cancer cells, during a surgical procedure. The recombinant peptides described herein can be administered topically and can be formulated into a variety of topically administrable compositions, such as solutions, suspensions, lotions, gels, pastes, medicated sticks, balms, creams, and ointments. Such pharmaceutical compositions can contain solubilizers, stabilizers, tonicity enhancing agents, buffers and preservatives.

In practicing the methods of treatment or use provided herein, therapeutically-effective amounts of the peptide described herein described herein can be administered in pharmaceutical compositions to a subject suffering from a condition that affects the immune system. In some embodiments, the subject is a mammal such as a human. A therapeutically-effective amount can vary widely depending on the severity of the disease, the age and relative health of the subject, the potency of the compounds used, and other factors.

Pharmaceutical compositions can be formulated using one or more physiologically-acceptable carriers comprising excipients and auxiliaries, which facilitate processing of the active compounds into preparations that can be used pharmaceutically. Formulation can be modified depending upon the route of administration chosen. Pharmaceutical compositions comprising a peptide described herein can be manufactured, for example, by expressing the peptide in a recombinant system, purifying the peptide, lyophilizing the peptide, mixing, dissolving, granulating, dragee-making, levigating, emulsifying, encapsulating, entrapping, or compression processes. The pharmaceutical compositions can include at least one pharmaceutically acceptable carrier, diluent, or excipient and compounds described herein as free-base or pharmaceutically-acceptable salt form.

Methods for the preparation of peptides or peptide-I/O complexes described herein, or a salt thereof, comprising the compounds described herein include formulating the peptide described herein with one or more inert, pharmaceutically-acceptable excipients or carriers to form a solid, semi-solid, or liquid composition. Solid compositions include, for example, powders, tablets, dispersible granules, capsules, cachets, and suppositories. These compositions can also contain minor amounts of nontoxic, auxiliary substances, such as wetting or emulsifying agents, pH buffering agents, and other pharmaceutically-acceptable additives.

Non-limiting examples of pharmaceutically-acceptable excipients can be found, for example, in Remington: The Science and Practice of Pharmacy, Nineteenth Ed (Easton, Pa.: Mack Publishing Company, 1995); Hoover, John E., Remington's Pharmaceutical Sciences, Mack Publishing Co., Easton, Pennsylvania 1975; Liberman, H. A. and Lachman, L., Eds., Pharmaceutical Dosage Forms, Marcel Decker, New York, N.Y., 1980; and Pharmaceutical Dosage Forms and Drug Delivery Systems, Seventh Ed. (Lippincott Williams & Wilkins 1999), each of which is incorporated by reference in its entirety.

Liposomes can be prepared by any methods known in the art, including Stealth and other liposomes. Liposome preparation can include drying down lipids from organic solvent, dispersing the liquid in aqueous media, and purification or sizing including sonication or extrusion as needed. Liposomes can be loaded by passive or active loading techniques, including mechanical dispersion, solid dispersion, detergent removal, any methods as disclosed in (Akbarzadeh et al. Nanoscale Research Letters 2013, 8:102), or any other methods known in the art.

Treatment of Cancer

The term "effective amount," as used herein, can refer to a sufficient amount of an agent or a compound being administered which will lead to an immune response to the tumor and reduction or elimination of cancer cells. The result can be reduction in the need for other, more toxic therapies, improvement in progression-free survival, improvement in long-term overall survival, a slower rate of progression, prevention of metastases, improvement in quality of life, remission, complete remission, partial remission, reduced symptoms, or any combination thereof. Compositions containing such agents or compounds can be administered for prophylactic, enhancing, and/or therapeutic treatments. An appropriate "effective" amount in any individual case can be determined using techniques, such as a dose escalation study.

The methods, compositions, and kits of this disclosure can comprise a method to prevent, treat, arrest, reverse, or ameliorate the symptoms of a condition when used alone or in combination with other treatments. Current treatments for cancer can involve the use of multiple drugs in addition to surgery and radiation. Combinations of a variety of treatments can be more effective than individual drugs, and can lead to a complete cure. Combinations can especially be important in the immuno-oncology field, where complementary and/or synergistic combinations are known. Combinations can be effective where individual drugs show no obvious effect. For example, radiation can be used in combination with chemotherapy in treatment of human carcinoma. Similar effects can be seen in mice (Dewan et al., Clin Cancer Res. 2012 Dec. 15; 18(24):6668-78). Radiation can be used in combination with any peptide-I/O complex of the present disclosure. Antibodies against the checkpoint inhibitors, PD1 and CTLA4, are recently approved drugs that can see enhanced therapeutic efficacy in combination with each other as well as with other drugs. This can be seen in mouse tumor models (Fallon 2017, Fu 2015,). Antibodies against said checkpoint inhibitors can be used in combination with any peptide-I/O complex of the present disclosure. Other checkpoint inhibitors being investigated such as TIM3, LAGS, KIR can also be administered in combination with any peptide-I/O complex of the present disclosure.

Peptide-I/O complexes of the present disclosure are designed to increase the efficacy or widen the therapeutic window of the I/O. Treatments that are efficacious in combination with the I/O alone can also be efficacious in combination with the peptide-I/O complex. Examples of such treatments include combination therapies that have shown preclinical or clinical activity: IL-15 agent, such as IL-15 superagonists, with anti-PD-L1, anti-CTLA-4, anti-CD40, or cyclophosphamide (Robinson and Schluns, Immunol Lett 190:159-168 (2017)); 4-1BB ligands with IL-12, anti-CTLA-4, anti-PD-1, radiation, cisplatin, 5-fluorouracil, cyclophosphamide, cetuximab, rituximab, or trastuzumab (Bartkowiak and Curran, Front Oncol 5:117 (2015)); STING ligands with vaccines, radiation, 5-fluorouracil, GM-CSF, or anti-PD-1 (Vargas et al., Eur J Cancer 75:86-97 (2017)). Other emerging immunotherapy targets may generate clinical therapeutics that can be combined with a peptide-I/O complex of the present disclosure to improve efficacy and/or reduce toxicity. These include members of the B7 family, including B7x, HHLA2, and B7-H3; VISTA; CD27; OX40/OX40L; GITR; Tim-3; LAG-3; BTLA; and IDO synthase (Assal et al, Immunotherapy 7:1169-1186 (2015)). The peptide-I/O complexes of the present disclosure can be administered alone or in combination with other therapies, diagnostic or imaging agents (whether linked to the peptide-I/O complex or used as a diagnostic or imaging agent linked to the peptide in conjunction with the peptide-I/O complex), such as I/O, chemical agents, biological agents, antibodies, radio-therapeutic agents, imaging agents, diagnostic agents, photosensitizing agents, radiosensitizing agents, nutrition, chemotherapy, toxins, protein, peptide, or small molecule chemotherapeutic entity of the following classes generally recognized as chemotherapies: alkylating agents, topoisomerase inhibitors, microtubulin inhibitors, cytotoxic antibiotics, and antimetabolites, such agent intended for or having therapeutic effect (whether curative, ameliorative or prophylactic), and the like. The peptide-I/O complexes of the present disclosure can be administered alone or in combination with a companion diagnostic or imaging agent (whether such diagnostic or imaging agent is linked to the peptide-I/O complex or used as a separate companion diagnostic or imaging agent linked to the peptide for use in conjunction with the peptide-I/O complex) such as chemical agents, radiolabel agents, radiosensitizing agents, fluorophores, imaging agents, diagnostic agents, protein, peptide, or small molecule such agent intended for or having diagnostic or imaging effect. Agents used for companion diagnostic agents and companion imaging agents can include the diagnostic and imaging agents described herein. Diagnostic tests can be used to enhance the use of therapeutic products, such as those disclosed herein. The development of therapeutic products with a corresponding diagnostic test, such as a test that uses diagnostic imaging (whether in vivo or in vitro) can aid in diagnosis, treatment, identify patient populations for treatment, and enhance therapeutic effect of the corresponding therapy. Tests also aid therapeutic product development to obtain the data FDA uses to make regulatory determinations. For example, such a test can identify appropriate subpopulations for treatment or identify populations who should not receive a particular treatment because of an increased risk of a serious side effect, making it possible to individualize, or personalize, medical therapy by identifying patients who are most likely to respond, or who are at varying degrees of risk for a particular side effect. Thus, the present disclosure, in some embodiments, includes the joint development of therapeutic products and diagnostic devices (used to detect the peptide I/O complexes themselves, or used to detect the companion diagnostic or imaging agent, whether such diagnostic or imaging agent is linked to the peptide-I/O complex or used as a separate companion diagnostic or imaging agent linked to the peptide for use in conjunction with the peptide-I/O complex) that are used in conjunction with safe and effective use of the peptide-I/O complexes as therapeutic products. Non-limiting examples of companion devices include a surgical instrument, such as an operating microscope, confocal microscope, fluorescence scope, exoscope, endoscope, or a surgical robot and devices used in biological diagnosis or imaging or that incorporate radiology, including the imaging technologies of X-ray radiography, magnetic resonance imaging (MRI), medical ultrasonography or ultrasound, endoscopy, elastography, tactile imaging, thermography, medical photography and nuclear medicine functional imaging techniques as positron emission tomography (PET) and Single-photon emission computed tomography (SPECT). Companion diagnostics and devices may comprise tests that are conducted ex vivo, including detection of signal from tissues or cells that are removed following administration of the companion diagnostic to the subject, or application of the companion diagnostic or companion imaging agent directly to tissues or cells following their removal from the subject and then detecting signal. Examples of devices used for ex vivo detection include fluorescence microscopes, flow cytometers, and the like.

The methods, compositions, and kits of this disclosure can comprise a method to prevent, treat, arrest, reverse, or ameliorate the symptoms of a condition. The treatment can comprise treating a subject (e.g., an individual, a domestic animal, a wild animal or a lab animal afflicted with a disease or condition) with a peptide of the disclosure. In treating a disease, the peptide or peptide-I/O complex can contact the tumor of a subject. The subject can be a human. A subject can be a human; a non-human primate such as a chimpanzee, or other ape or monkey species; a farm animal such as a cattle, horse, sheep, goat, swine; a domestic animal such as a rabbit, dog, and cat; a laboratory animal including a rodent, such as a rat, mouse and guinea pig, or the like. A subject can be of any age. A subject can be, for example, an elderly adult, adult, adolescent, pre-adolescent, child, toddler, infant, or fetus in utero.

Treatment can be provided to the subject before clinical onset of disease. Treatment can be provided to the subject after clinical onset of disease. Treatment can be provided to the subject after 1 day, 1 week, 6 months, 12 months, or 2 years or more after clinical onset of the disease. Treatment may be provided to the subject for more than 1 day, 1 week, 1 month, 6 months, 12 months, 2 years or more after clinical onset of disease. Treatment may be provided to the subject for less than 1 day, 1 week, 1 month, 6 months, 12 months, or 2 years or 5 years after clinical onset of the disease. Treatment can also include treating a human in a clinical trial. A treatment can comprise administering to a subject a pharmaceutical composition, such as one or more of the pharmaceutical compositions described throughout the disclosure. A treatment can comprise a once daily dosing. A treatment can comprise a single dose or two doses. A treatment can comprise once weekly, biweekly, or monthly dosing, or dosing one to five times per year. A treatment can comprise administering a peptide or peptide-I/O complex to a subject, either parenterally, intravenously, subcutaneously, intramuscularly, by inhalation, dermally, intra-articular injection, orally, intrathecally, transdermally, intranasally, via a peritoneal route, or directly onto the tumor or into the tumor microenvironment, e.g., via a direct injection route.

In some embodiments, the present disclosure provides a method for treating a cancer or tumor, the method comprising administering to a subject in need thereof an effective amount of a peptide or peptide-I/O complex of the present disclosure. One example of cancers or conditions that can be treated with a peptide or peptide-I/O complex of the disclosure is solid tumors. Another example of cancers that can be treated with a peptide or peptide-I/O complex of this disclosure are liquid tumors such as lymphomas, leukemias, and hematological malignancies. Further examples of cancers or conditions that can be treated with a peptide or peptide-I/O complex of the disclosure include triple negative breast cancer, breast cancer, breast cancer metastases, metastases of any cancers described herein, colon cancer, colon cancer metastases, sarcomas, acute lymphoblastic leukemia, acute myeloid leukemia, adrenocortical carcinoma, AIDS-related cancers such as Kaposi sarcoma, AIDS-related lymphoma, primary CNS lymphoma, anal cancer, appendix cancer, childhood astrocytomas, astrocytomas, childhood atypical teratoid/rhabdiod tumor, CNS atypical teratoid/rhabdiod tumor, atypical teratoid/rhabdiod tumor, basal cell carcinoma, skin cancer, bile duct cancer, bladder cancer, bone cancer, Ewing sarcoma family of tumors, osteosarcoma, chondroma, chondrosarcoma, primary and metastatic bone cancer, malignant fibrous histiocytoma, childhood brain stem glioma, brain stem glioma, brain tumor, brain and spinal cord tumors, central nervous system embryonal tumors, childhood central nervous system embryonal tumors, central nervous system germ cell tumors, childhood central nervous system germ cell tumors, craniopharyngioma, childhood craniopharyngioma, ependymoma, childhood ependymoma, breast cancer, bronchial tumors, childhood bronchial tumors, burkitt lymphoma, carcinoid tumor, gastrointestinal cancer, carcinoma of unknown primary, cardiac tumors, childhood cardiac tumors, primary lymphoma, cervical cancer, cholangiocarcinoma, chordoma, childhood chordoma, chronic lymphocytic leukemia, chronic myelogenous leukemia, chronic myeloproliferative neoplasms, colon cancer, colorectal cancer, cutaneous T cell lymphoma, diffuse midline glioma, ductal carcinoma in situ, embryonal tumors, endometrial cancer, ependymoma, esophageal cancer, esthesioneuroblastoma, childhood esthesioneuroblastoma, ewing sarcoma, extracranial germ cell tumor, childhood extracranial germ cell tumor, extragonadal germ cell tumor, eye cancer, intraocular melanoma, retinoblastoma, fallopian tube cancer, fibrous histiocytoma of bone, gallbladder cancer, gastric cancer, gastrointestinal carcinoid tumor, gastrointestinal stromal tumors, ovarian cancer, testicular cancer, gestational trophoblastic disease, glioma, glioblastoma multiforme (GBM), low-grade glioma (LGG), gliomatosis cerebri, hairy cell leukemia, head and neck cancer, hepatocellular cancer, histiocytosis, Langerhans cell histiocytosis, hodgkin lymphoma, hypopharyngeal cancer, intraocular melanoma, melanoma, melanoma metastases, islet cell tumors, pancreatic neuroendocrine tumors, kidney cancer, renal cell tumors, Wilms tumor, childhood kidney tumors, lip and oral cavity cancer, liver cancer, lung cancer, medulloblastoma, nonhodgkin lymphoma, macroglodulinemia, Waldenstrom macroglodulinemia, male breast cancer, merkel cell carcinoma, metastatic squamous neck cancer with occult primary, midline tract carcinoma involving NUT gene, mouth cancer, multiple endocrine neoplasia syndromes, childhood multiple endocrine neoplasia syndromes, multiple myeloma/plasma cell neoplasm, mycosis fungoides, myelodysplastic syndromes, myelodysplastic/myeloproliferative neoplasms, multiple myeloma, myloproliferative neoplasms, chronic myeloproliferative neoplasms, myxopapillary ependymoma, nasal cavity and paranasal sinus cancer, nasopharyngeal cancer, neuroblastoma, non-small cell lung cancer, oligodendroglioma, oligoastrocytoma, oropharyngeal cancer, ovarian cancer, low malignant potential tumor, pancreatic cancer, pancreatic neuroendocrine tumors, papillomatosis, childhood papillomatosis, paraganglioma, paranasal sinus and nasal cavity cancer, parathyroid cancer, penile cancer, pheochromocytoma, pharyngeal cancer, pilocytic astrocytoma, pituitary tumor, pleomorphic xanthoastrocytoma (PXA), pleuropulmonary blastoma, childhood pleuropulmonary blastoma, primary peritoneal cancer, prostate cancer, rectal cancer, pregnancy-related cancer, rhabdomyosarcoma, childhood rhabdomyosarcoma, salivary gland cancer, Sezary syndrome, small cell lung cancer, small intestine caner, soft tissue sarcoma, squamous cell carcinoma, testicular cancer, throat cancer, thymoma, thymic carcinoma, thyroid cancer, transitional cell cancer of the renal, pelvis, and ureter, uterine cancer, urethral cancer, endometrial cancer, uterine sarcoma, vaginal cancer, vascular tumors, and vulvar cancers.

In certain embodiments, the peptide of the disclosure is mutated to home, distribute to, target, migrate to, accumulate in, or is directed to certain tissues but not to others, to change the strength or specificity of its function, or to gain or lose function.

In some embodiments, the present disclosure provides a method for treating a cancer, the method comprising administering to a subject in need thereof an effective amount of a peptide or peptide-I/O complex of the present disclosure.

In some embodiments, the present disclosure provides a method for treating a cancer, the method comprising administering to a patient in need thereof an effective amount of a pharmaceutical composition comprising a peptide or peptide-I/O complex of the present disclosure and a pharmaceutically acceptable carrier.

In some embodiments, the present disclosure provides a method for inhibiting invasive activity of cells, the method comprising administering an effective amount of a peptide or peptide-I/O complex of the present disclosure to a subject.

A peptide comprising the sequence of any of SEQ ID NO: 1-SEQ ID NO: 1134, SEQ ID NO: 1243-SEQ ID NO: 1262, or SEQ ID NO: 1263-SEQ ID NO: 1316, and any peptide derivative or peptide-I/O complex as described herein, can be used to target cancers (e.g., brain tumors, breast cancer, soft tissue sarcoma, renal cell cancer, small cell lung cancer, colorectal cancer, upper GI cancers, pancreatic cancer, prostate cancer, squamous cell carcinoma of the head and neck, urothelial carcinoma, ovarian carcinoma, synovial carcinoma, bladder carcinoma, salivary gland carcinoma, uterine carcinoma, esophageal carcinoma, gastric cancer, cervical carcinoma, skin cancer, osteosarcoma, or any other solid tumor). A peptide comprising the sequence of any of SEQ ID NO: 1-SEQ ID NO: 1134, SEQ ID NO: 1243-SEQ ID NO: 1262, or SEQ ID NO: 1263-SEQ ID NO: 1316, and any peptide derivative or peptide-I/O complex as described herein, can be used to additionally target any cancers, or to target delivery of the I/O intracellularly, optionally to the cytoplasm, the endosome, or subcellular compartments.

In some embodiments, the peptides described herein provide a method of treating a cancer condition of a subject, the method comprising administering to the subject a therapeutically-effective amount of a peptide-I/O complex comprising the sequence SEQ ID NO: 1 or fragment thereof. In some embodiments, the peptides described herein provide a method of treating a cancer condition of a subject, the method comprising administering to the subject a peptide-I/O complex of any one of SEQ ID NO: 1-SEQ ID NO: 1134, SEQ ID NO: 1243-SEQ ID NO: 1262, or SEQ ID NO: 1263-SEQ ID NO: 1316 or fragment thereof.

Venom or toxin derived peptide(s), peptides, modified peptides, labeled peptides, peptide-I/O complexes, and pharmaceutical compositions described herein can be administered for therapeutic treatments. In therapeutic applications, the composition can be administered to a subject already suffering from a disease or condition, in an amount sufficient to cure or at least partially arrest the symptoms of the disease or condition, or to cure, heal, improve, or ameliorate the condition. Such peptides described herein can also be administered to prevent (either in whole or in part), lessen a likelihood of developing, contracting, or worsening a condition. Amounts effective for this use can vary based on the severity and course of the disease or condition, previous therapy, the subject's health status, weight, response to the drugs, and the judgment of the treating physician. Venom or toxin derived peptide(s), peptides, modified peptides, labeled peptides, peptide-I/O complexes, and pharmaceutical compositions described herein can allow for targeted homing of the peptide, peptide-I/O complex, and local delivery of any conjugate. For example, a peptide conjugated or co-formulated in a complex (e.g. liposomal formulation) with an I/O such as an IL-15 agent, 4-1BB ligands, RIG-I ligands, and/or STING ligands allows for local delivery of the I/O, which is significantly more effective and less toxic than traditional systemic deliver of I/O.

Some cancers can be in the brain or central nervous system (CNS). Various therapeutic treatments, such as I/Os, can be unable to cross the blood brain barrier (BBB) or enter the CNS at therapeutically adequate levels. Peptides of this disclosure, or variants thereof, can be BBB penetrating and can deliver I/Os to cancers of the CNS and the brain. Alternatively, peptides of this disclosure, or variants thereof, can be non-BBB penetrating in order to treat peripheral tumors while protecting the brain from exposure to I/Os.

Kits

Peptides or peptide-I/O complexes can be packaged as a kit. In some embodiments, a kit includes written instructions on the use or administration of the peptides, I/Os, peptide-I/O complexes, or any combination thereof.

EXAMPLES

The following examples are included to further describe some embodiments of the present disclosure, and should not be used to limit the scope of the disclosure.

Example 1

Manufacture of Peptides by Recombinant Expression

This example describes manufacture of peptides by recombinant expression. The peptide sequence is reverse-translated into DNA, synthesized, and cloned in-frame with siderocalin using standard molecular biology techniques. (M. R. Green, Joseph Sambrook. Molecular Cloning. 2012 Cold Spring Harbor Press.). The resulting construct is packaged into a lentivirus, transfected into HEK293 cells, expanded, isolated by immobilized metal affinity chromatography (IMAC), cleaved with tobacco etch virus protease, and purified to homogeneity by reverse-phase chromatography. Following purification, each peptide is lyophilized and stored frozen.

Example 2

Synthetic Manufacturing of Peptides

This example describes synthetic manufacturing of peptides. The peptide sequence was synthesized by solid phase peptide synthesis using standard Fmoc chemistry and protecting strategies. After synthesis, the peptide was cleaved from the resin and purified by reversed-phase chromatography. The peptide was folded and disulfides bonds were formed by incubation at mildly basic pH using a redox pair for oxidation. The folded peptide was then purified by reversed-phase chromatography, buffer exchanged, and lyophilized. The peptide was characterized by RP-HPLC, mass spectrometry, and optionally by other techniques such as 2D-NMR and LC-MS peptide mapping.

Peptides of SEQ ID NO: 568, SEQ ID NO: 683, and SEQ ID NO: 569 were synthesized by Fmoc chemistry, cleaved from the resin, folded, and purified. The mass of each peptide was verified by LC-MS and their purity was characterized by RP-HPLC.

Any of the peptides of the disclosure can be manufactured in a similar manner.

Example 3

Radiolabeling of Peptide

This example describes radiolabeling of peptides with standard techniques, such as reductive alkylation. See J Biol Chem. 254(11):4359-65 (1979); Methods in Enzymology V91:1983 p. 570 and Journal of Biological Chemistry 254 (11):1979 p. 4359. An excess of $^{14}C$ formaldehyde is used to ensure complete methylation (dimethylation of every free amine). The labeled peptides is isolated via solid-phase extraction on Strata-X columns (Phenomenex 8B-S100-AAK), rinsed with water with 5% methanol, and recovered in methanol with 2% formic acid. Solvent is subsequently removed in a blowdown evaporator with gentle heat and a stream of nitrogen gas.

Example 4

Isotopic Labelling of Peptides

This example describes isotopic labelling of peptides. During solid phase peptide synthesis, an isotopically labeled amino acid, $^{15}N$ $^{13}C$ arginine, was incorporated in the peptide. The isotopically labeled peptide was produced. The peptide was used to measure levels of peptide or peptide I/O complex in biological samples.

Solid-phase peptide synthesis was performed to generate a peptide of SEQ ID NO: 569, in which isotopically labeled arginine was incorporated. Arg14, Arg15 and Arg23 were incorporated with uniformly labelled $^{13}C_6$ (98%) and $^{15}N_4$ (98%) resulting in a properly folded peptide of SEQ ID NO: 569. The isotopically labeled peptide was further modified by conjugating a near-infrared dye ICG-sulfo to lysine 27 resulting in isotopically labeled conjugate with a mass of 4795.5 Daltons and a purity of 96%. The conjugate was successfully used to measure levels of peptides in the blood in animal studies.

Any of the peptides of the disclosure can be labelled in a similar manner.

Example 5

Peptide Detectable Agent Conjugates

This example describes the dye labeling of peptides. A peptide of SEQ ID NO: 2 or SEQ ID NO: 569 (non-GS version of SEQ ID NO: 2) was expressed recombinantly or chemically synthesized, and then the N-terminus of the peptide and/or the side chain amine of one or more lysine residues was conjugated to an detectable agent via an amide bond to produce a peptide-detectable agent conjugate. The detectable agent was an indocyanine green dye (ICG).

Figure 23:
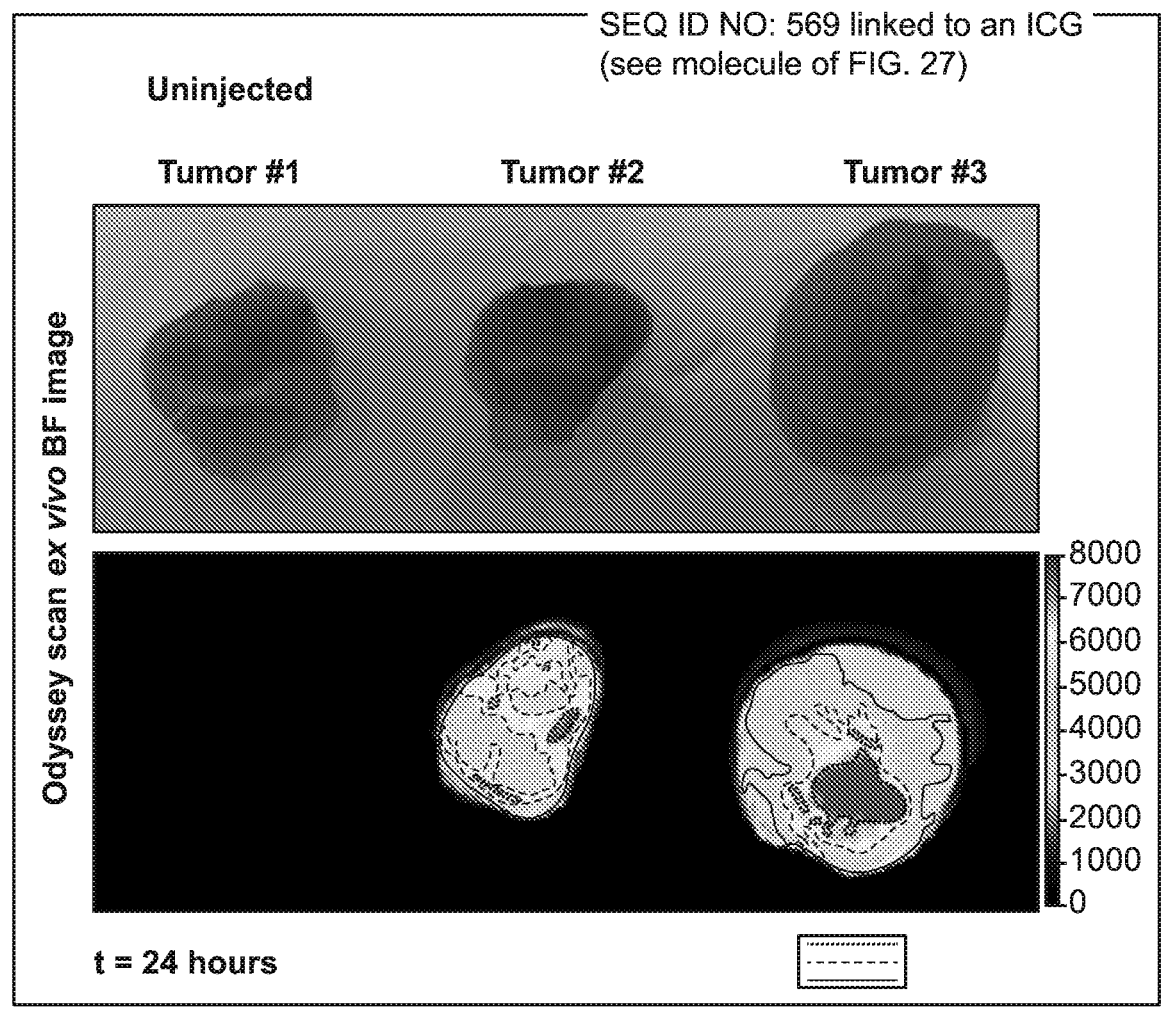
FIG. 23 illustrates a white light image (top row) and the fluorescence signal (bottom row) in a CT26 tumor of a control, uninjected mouse and the signal in tumors from 2 mice that were injected with a peptide of SEQ ID NO: 569 conjugated to an ICG dye (see molecule shown in FIG. 27).
Figure 24:
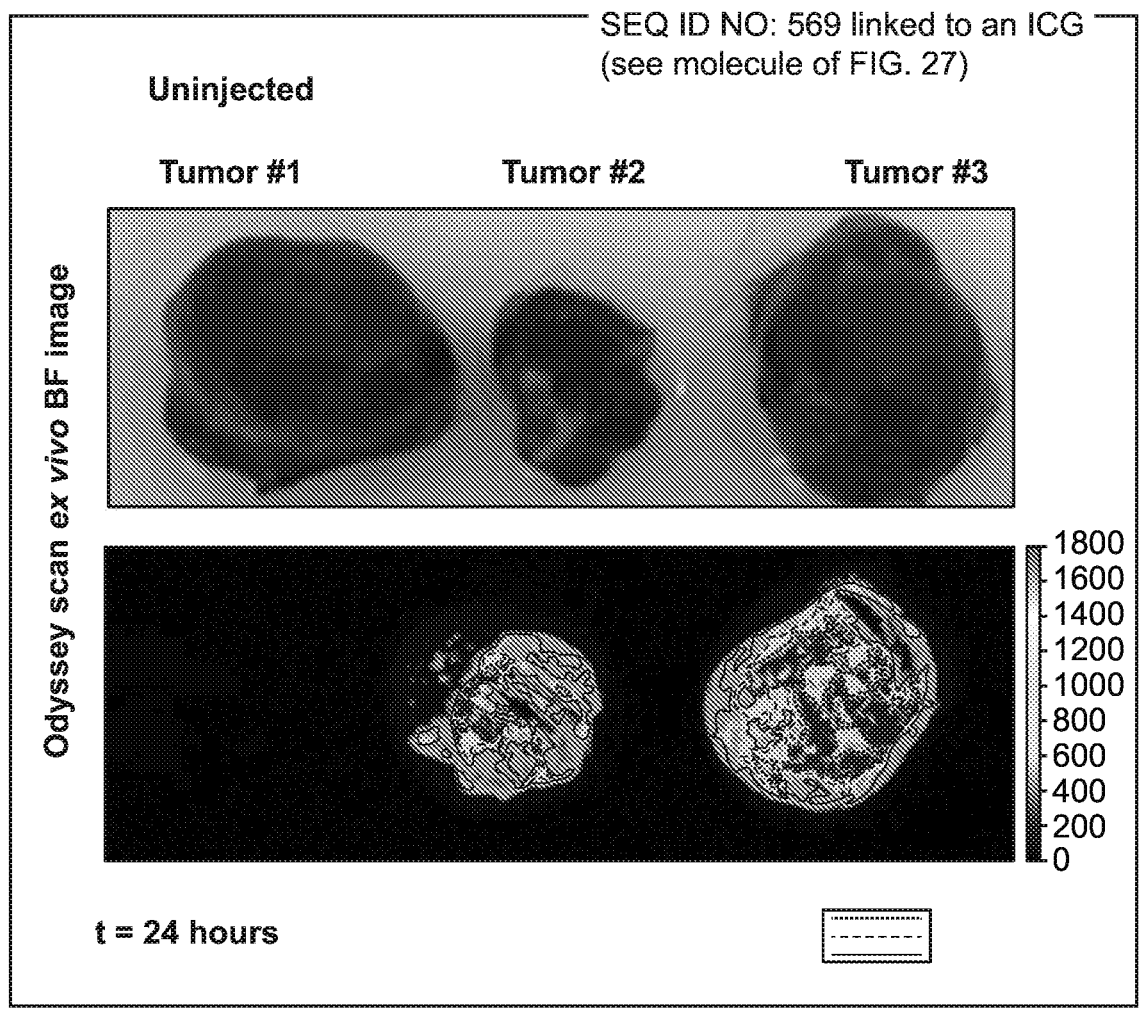
FIG. 24 illustrates a white light image (top row) and the fluorescence signal (bottom row) in a B16F10 tumor of a control, uninjected mouse and the signal in tumors from 2 mice that were injected with a peptide of SEQ ID NO: 569 conjugated to an ICG dye (see molecule shown in FIG. 27).
Figure 25:
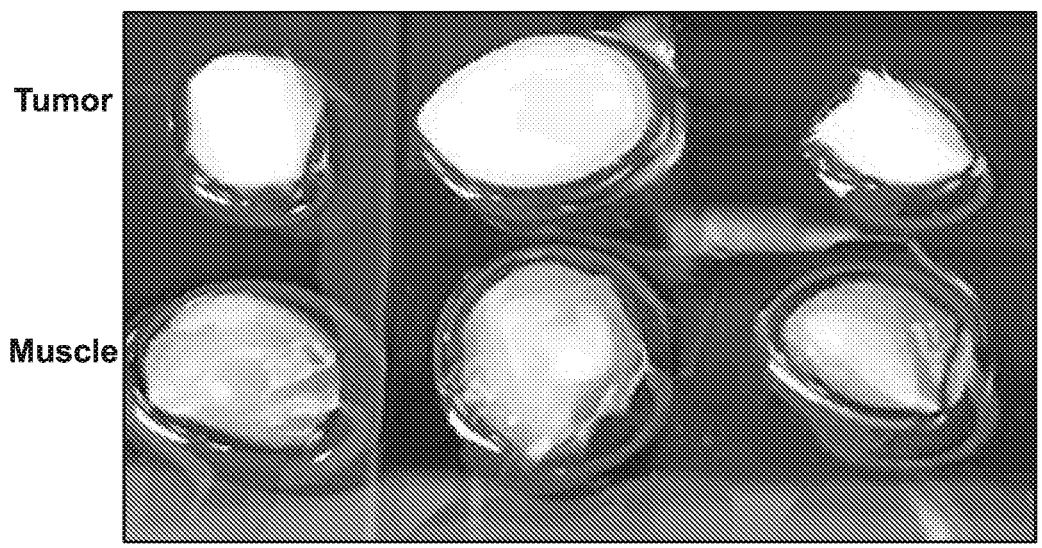
FIG. 25 illustrates a white light image (top row) and the fluorescence signal in a A20 tumor and in the muscle of a control, uninjected mouse and the signal in tumors and in the muscle (contralateral flank) from 2 mice that were injected with a peptide of SEQ ID NO: 569 conjugated to an ICG dye (see molecule shown in FIG. 27).
Figure 25:
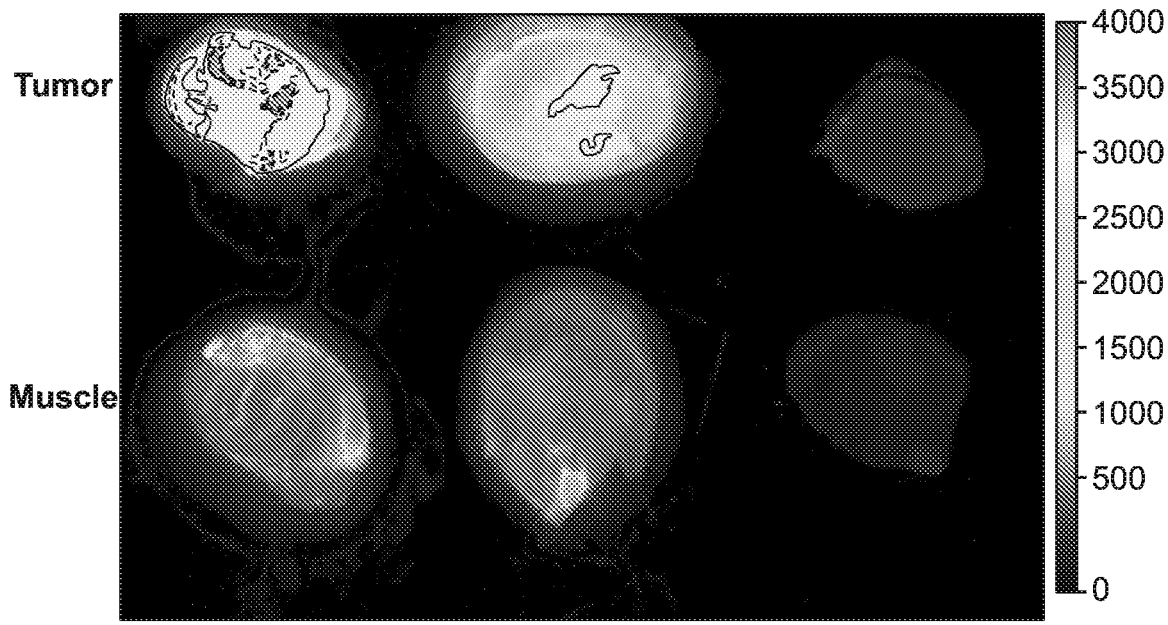
Figure 25:
Figure 27:
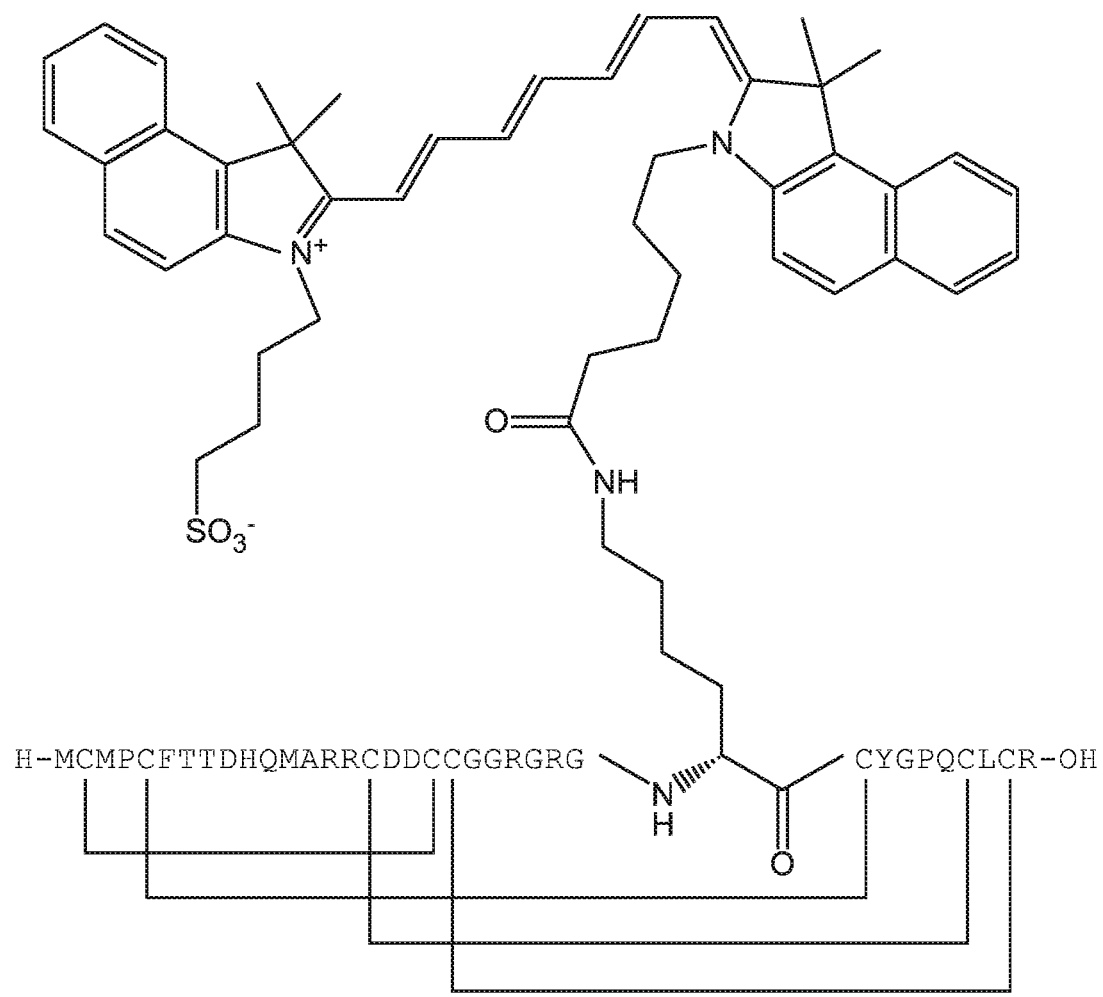
FIG. 27 illustrates the structure of the peptide of SEQ ID NO. 569 conjugated to an ICG dye, with lines representing disulfide bonds between cysteine residues.

The peptide detectable agent conjugates were administered to a subject. The subject was a non-human animal in which cancer cells had been implanted and allowed to grow into tumors. After administration, the peptide detectable agent conjugates homed to the tumors. The subject, or a tissue from the subject, was imaged to visualize localization of the peptide detectable agent conjugates to tumors. Visualization of the peptide detectable agent conjugates in tumors after administration could be used as imaging or diagnostic agents in diagnosis of cancer. Confirmation of cancer in subject biopsies was confirmed by standard histopathology. A peptide of SEQ ID NO: 568 was applied to cells such as human glioma U373 or U87 cells or human lung carcinoma A549 cells and incubated for 24 h. The peptide was either applied by itself and detected by immunocytochemistry or was labeled with an Alexa-488 fluorescent dye prior to application, then imaged by confocal microscopy. The peptide penetrated the cell and was detected at locations inside the cells such as near the trans-Golgi and in the perinuclear areas. Wiranowska et al., Cancer Cell Intl 11:1-13 (2011). Studies were performed to demonstrate the tumor accumulation of peptides disclosed herein. A peptide of SEQ ID NO: 569 was conjugated to an ICG dye to synthesize the molecule shown in FIG. 27. For generating allografts, mice (Female Balbc and C57BL6/J; Envigo) were inoculated with CT26, B16F10, or A20 cells in a 100 µl volume. Tumors were allowed to grow for 12-15 days post implantation and then tumor-bearing mice were IV injected with 10 nanomoles (100 µL volume) of a peptide of SEQ ID NO: 569 conjugated to an ICG dye. Tumors were resected 24 hours post administration and imaged using a near-infrared fluorescence scanner. FIG. 23 illustrates a white light image and the fluorescence signal in a CT26 tumor of a mouse that was not injected with a peptide of SEQ ID NO: 569 conjugated to an ICG dye and the signal in tumors from 2 mice that were injected with a peptide of SEQ ID NO: 569 conjugated to an ICG dye. FIG. 24 shows a white light image and the fluorescence signal in a B16F10 tumor of a mouse that was not injected with a peptide of SEQ ID NO: 569 conjugated to an ICG dye and the signal in tumors from 2 mice that were injected with a peptide of SEQ ID NO: 569 conjugated to an ICG dye. FIG. 25 shows a white light image and the fluorescence signal in a A20 tumor and in the muscle (contralateral flank) of a mouse that was not injected with a peptide of SEQ ID NO: 569 conjugated to an ICG dye and the signal in tumors and in the muscle (contralateral flank) from 2 mice that were injected with a peptide of SEQ ID NO: 569 conjugated to an ICG dye. The signal in tumor in the peptide of SEQ ID NO: 569 conjugated to an ICG dye-treated A20 mice were 5-11 times higher than the signal in muscle in these treated mice. Signal in tumors were 2000-4000-fold higher in CT26 tumors and 1000-1500 fold higher in B16F10 tumors than the signal in the tumor of the untreated mouse in each group. These data show that a peptide of SEQ ID NO: 569 conjugated to an ICG dye accumulate in CT26 colon cancer tumors, B16F10 melanoma tumors, and A20 lymphoma tumors in vivo.

Any of the peptides of the present disclosure can be labelled in a similar manner using an ICG dye. Other detectable dyes can be used to label peptides of the present disclosure as described herein.

Example 6

Dosing of Peptide

This example describes a dosing scheme for administering peptides to mice. Different dosages of the peptides are administered to Female Harlan athymic nude mice, weighing 20 g-25 g, via tail vein injection (n=2 mice per peptide). Optionally, the kidneys are ligated to prevent renal filtration of the peptides. Optionally, each peptide is radiolabeled by methylating lysines and the N-terminus, so the actual binding agent can contain methyl or dimethyl lysine(s) and a methylated or dimethylated amino terminus, and/or each peptide is labeled with a detectable agent such as Cy5.5-NHS ester.

A target dosage of 50-100 nmol of each peptide carrying 10-25 uCi of $^{14}C$, optionally comprising a fluorophore in a 1:1 molar ratio with the peptide is administered to Female Harlan athymic nude mice. Each peptide is allowed to freely circulate within the animal before the animals are euthanized and sectioned.

Example 7

Peptide Homing

This example illustrates peptide homing to tumors of mice. At the end of the dosing period in EXAMPLE 6, mice are frozen in a hexane/dry ice bath and then frozen in a block of carboxymethylcellulose. Whole animal sagittal slices are prepared that resulted in thin frozen sections being available for imaging. Thin, frozen sections of animal including imaging of tissues such as brain, tumor, liver, kidney, lung, heart, spleen, pancreas, muscle, adipose, gall bladder, upper gastrointestinal tract, lower gastrointestinal tract, bone, bone marrow, reproductive track, eye, cartilage, stomach, skin, spinal cord, bladder, salivary gland, and other types of tissues are obtained with a microtome, allowed to desiccate in a freezer, and exposed to phoshoimager plates for about ten days.

For radiolabeled peptide, these plates are developed, and the signal (densitometry) from each organ is normalized to the signal found in the heart blood of each animal. For detectable agent peptide conjugate, the tissue is imaged with a fluorescence imager or fluorescence microscopy. A signal in tissue stronger than the signal expected from blood that is present in that tissue indicates peptide accumulation in a region, tissue, structure or cell. Alternatively, tissues are harvested, homogenized, and analyzed for peptide content in different tissues, such as by liquid scintillation counting (radiolabeled) or absorbance measurements (detectable agent conjugate).

Example 8

Peptide Conjugates with Stable Linkers

This example describes preparation of peptide conjugates with stable linkers. A peptide of the disclosure is expressed recombinantly or chemically synthesized. The peptide is conjugated to a detectable agent or an I/O or any other active agent via a stable linker, such as an amide linkage or a carbamate linkage. The peptide is conjugated using standard 1-ethyl-3-(3-dimethylaminopropyl)carbodiimide (EDC) or dicyclohexylcarbodiimide (DCC) based chemistry or thionyl chloride or phosphorous chloride-based bioconjugation chemistries or other chemistries such as described in this disclosure.

A peptide and I/O conjugated via a linker are described with the formula Peptide-A-B-C-I/O, wherein the linker is A-B-C. A can be a stable amide link such as that formed by reacting an amine on the peptide with a linker containing a tetrafluorophenyl (TFP) ester or an NHS ester or an ATT (acyl-1,3-thiazolidine-2-thione) group. A can also be a stable carbamate linker such as that formed by reacting an amine on the peptide with an imidazole carbamate active intermediate formed by reaction of CDI with a hydroxyl on the linker. A can also be a stable secondary amine linkage such as that formed by reductive alkylation of the amine on the peptide with an aldehyde or ketone group on the linker. A can also be a stable thioether linker formed using a maleimide or bromoacetamide in the linker with a thiol in the peptide, a triazole linker, a stable oxime linker, or a oxacarboline linker. B is ($-CH2-$)$_x$- or a short PEG ($-CH_2CH_2O-$)$_x$ (x is 0-20) or other spacers or no spacer. C is an amide bond formed with an amine or a carboxylic acid on the I/O, a thioether formed between a maleimide on the linker and a sulfhydryl on the I/O, a secondary or tertiary amine, a carbamate, or other stable bonds or is not present beyond the link formed as A. Any linker chemistry described in "Current ADC Linker Chemistry," Jain et al., Pharm Res, 2015 DOI 10.1007/s11095-015-1657-7 or in 'Bioconjugate Techniques" by Greg Hermanson, 3rd edition can be used.

The resulting peptide conjugates are administered to a human or animal subcutaneously, intravenously, orally, or injected directly into a tumor to treat disease. The peptide is not specifically cleaved from the detectable agent, an I/O, or active agent via a targeted mechanism. The peptide can be degraded by mechanisms such as catabolism, releasing a drug that is modified or not modified form its "native" or initial form (Antibody-Drug Conjugates: Design, Formulation, and Physicochemical Stability, Singh, Luisi, and Pak. Pharm Res (2015) 32:3541-3571). The peptide drug conjugate exerts its pharmacological activity while still intact, or while partially or fully degraded, metabolized, or catabolized.

Example 9

Peptide Conjugates with Cleavable Linkers

This example describes preparation of peptide conjugates having cleavable linkers. A peptide of the disclosure is expressed recombinantly or chemically synthesized. A peptide and I/O are conjugated via a linker and is described with the formula Peptide-A-B-C-I/O, wherein the linker is A-B-C. A is a stable amide link such as that formed by reacting an amine on the peptide with a linker containing a tetrafluorophenyl (TFP) ester or an NHS ester or an ATT group. A can also be a stable carbamate linker such as that formed by reacting an amine on the peptide with an imidazole carbamate active intermediate formed by reaction of CDI with a hydroxyl on the linker. A can also be a stable secondary amine linkage such as that formed by reductive alkylation of the amine on the peptide with an aldehyde or ketone group on the linker. A can also be a stable thioether linker formed using a maleimide or bromoacetamide in the linker with a thiol in the peptide, a triazole linker, a stable oxime linker, or a oxacarboline linker. Optionally A is not present as the peptide is directly conjugated via the cleavable link at C. B is ($-CH2-$)$_x$- or a short PEG ($-CH_2CH_2O-$)$_x$ (x is 0-20) or other spacers or no spacer. C is an ester bond to the hydroxyl or carboxylic acid on the I/O, or a carbonate, hydrazone, or acylhydrazone, designed for hydrolytic and/or enzymatic cleavage. The rate of cleavage is varied by varying the local environment around the ester, including carbon length ($-CH2-$)x, steric hindrance (including adjacent side groups such as methyl, ethyl, cyclic), hydrophilicity or hydrophobicity. Hydrolysis rate is affected by local pH, such as lower pH in certain compartments of the body or of the cell such as endosomes and lysosomes or diseased tissues. Alternatively, C is a pH sensitive group such as a hydrazone or oxime linkage. Alternatively, C is a disulfide bond designed to be released by reduction, such as by glutathione. Alternatively, C (or A-B-C) is a peptidic linkage design for cleavable by enzymes. Optionally, a self-immolating group such as pABC is included to cause release of a free unmodified drug upon cleavage (Antibody-Drug Conjugates: Design, Formulation, and Physicochemical Stability, Singh, Luisi, and Pak. Pharm Res (2015) 32:3541-3571). The linker is cleaved by enzymes such as esterases, matrix metalloproteinases, cathepsins such as cathepsin B, glucuronidases, a protease, or thrombin. Alternatively, the bond designed for cleavage is at A, rather than C, and C could be a stable bond or a cleavable bond. An alternative design is to have stable linkers (such as amide or carbamate) at A and C and have a cleavable linker in B, such as a disulfide bond. The rate of reduction is modulated by local effects such as steric hindrance from methyl or ethyl groups or modulating hydrophobicity/hydrophilicity.

The resulting peptide conjugates are administered to a human or animal subcutaneously, intravenously, orally, or injected directly into a tumor to treat disease.

Example 10

Figure 1D:
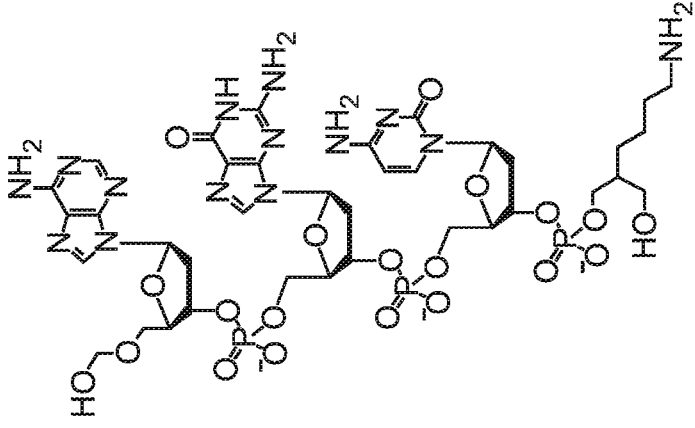

Installation of a Thiol Group, an Amine Group, or an Aldehyde Group in RNA or DNA This example describes incorporation of a thiol group, an amine group, or an aldehyde group in RNA or DNA. FIG. 1 illustrates incorporation or addition of these groups on RNA or DNA. A thiol group is added on RNA or DNA, for example on a RIG-I ligand or an MDA5 ligand, using EDC and imidazole to activate the 5' phosphate group to a phosphorylimidazolide, and by subsequently reacting the resulting product with cystamine. This is followed by reduction with dithiothreitol (DTT) to form a phosphoramidite linkage to a free thiol group. A thiol group is, alternatively, added on RNA or DNA by incorporating a phosphoramidite that contains a thiol during solid-phase phosphoramidite oligonucleotide synthesis, at either the 5'-end or the 3'-end of the oligonucleotide as shown in FIG. 1. The phosphoramidite used during synthesis can have a protecting group on the thiol during synthesis that is removed during cleavage, purification, and workup. FIG. 1A illustrates structures of oligonucleotides containing a 5'-thiol (thiohexyl; C6) modification (left), and a 3'-thiol (C3) modification (right), as shown at https://www.atdbio.com/content/50/Thiol-modified-oligonucleotides.

An amine group is added on RNA or DNA by incorporating a phosphoramidite during synthesis that contains a protected amino group that is later deprotected. FIG. 1B illustrates an MMT-hexylaminolinker phosphoramidite. FIG. 1C illustrates a TFA-pentylaminolinker phosphoramidite, as shown at https://www.sigmaaldrich.com/catalog/product/sigma/m01023hh?lang=en&region=US.

Alternatively, thiol or amine containing oligonucleotide residues are included within the sequence at any chosen location in RNA or DNA, such as described by Jin et al. (J Org Chem. 2005 May 27; 70(11):4284-99). FIG. 1D illustrates RNA residues incorporating amine or thiol residues, as presented in Jin et al. (J Org Chem. 2005 May 27; 70(11): 4284-99). Also, an oligonucleotide residue that contains a phosphorothioate group within the phosphodiester backbone (where a sulfur atom replaces a non-bridging oxygen in the phosphate backbone of the oligonucleotide) provides a reactive group that is similarly used for conjugation to a thiol group. Use of the phosphorothioate containing residues can also make the RNA more resistant to nuclease degradation.

Figure 1E:
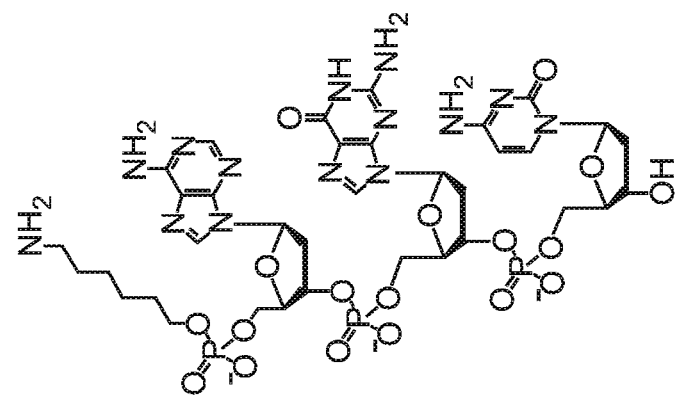
FIG. 1E illustrates oligonucleotides with aminohexyl modifications at the 5' (left) and 3' ends (right).

FIG. 1E illustrates oligonucleotides with aminohexyl modifications at the 5' (left) and 3' ends (right).

Aldehyde functional groups can be incorporated at the 3' end of RNA by using periodate oxidation to convert the diol into two aldehyde groups.

Other methods of incorporating or modifying functional groups are carried out using techniques set forth in Bioconjugate Techniques, by Greg Hermanson, 3rd edition.

Example 11

Incorporation of a Carboxylate Group, a Thiol Group, or an Amine Group on Cyclic Dinucleotide This example describes incorporation of a carboxylate group, a thiol group, or an amine group on cyclic dinucleotides. The cyclic dinucleotides serves as a STING ligand, which is an I/O of the present disclosure that is coupled to any one of peptides of SEQ ID NO: 1-SEQ ID NO: 1134, SEQ ID NO: 1243-SEQ ID NO: 1262, or SEQ ID NO: 1263-SEQ ID NO: 1316.

A hydroxyl group in a cyclic dinucleotide is reacted with chloroacetic acid to form a carboxylate. The carboxylate is converted into an amine group by subsequent reaction with a diamine, such as ethylene diamine, using EDC. Alternatively, the carboxylate is converted into a thiol group by subsequent reaction with cystamine, using EDC. This is followed by reduction, for example, with dithiothreitol (DTT). The resulting cyclic dinucleotide is ready for couple to any peptide of the instant disclosure and is administered to agonize STING.

Figure 12A:
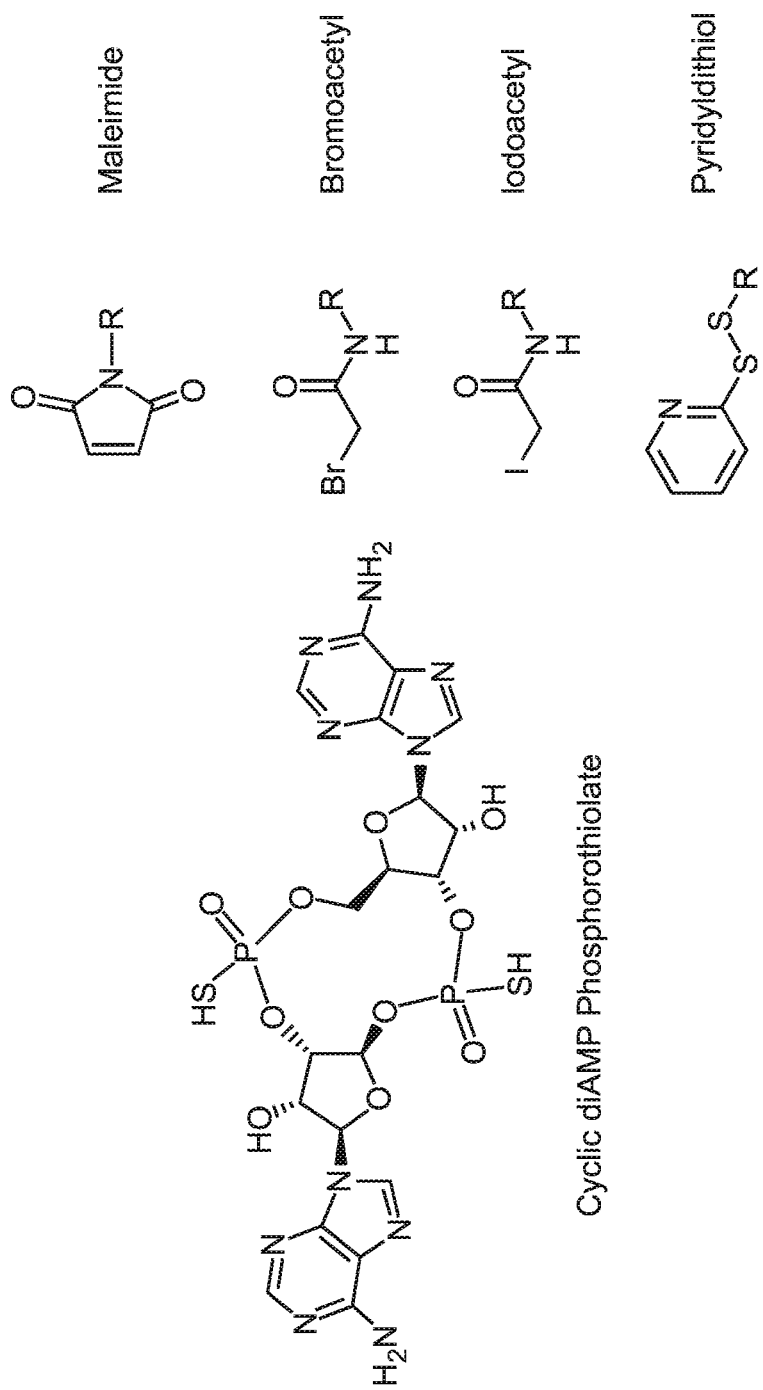
FIG. 12A illustrates a STING ligand I/O comprising bis-phosphorothioate in the cyclic phosphodiester, which can serve as a reactive thiol during conjugation. Said thiol can be reacted with maleimide, bromoacetyl, iodoacetyl, or pyridyldithiol groups.

Alternatively, a STING ligand comprising bis-phosphorothioate linkages in the cyclic phosphodiester provides reactive thiols that can be used as the I/O in the peptide-I/O complex. These thiols are reacted with maleimide, bromoacetyl, iodoacetyl, or pyridyldithiol groups (FIG. 12A).

Figure 12B:
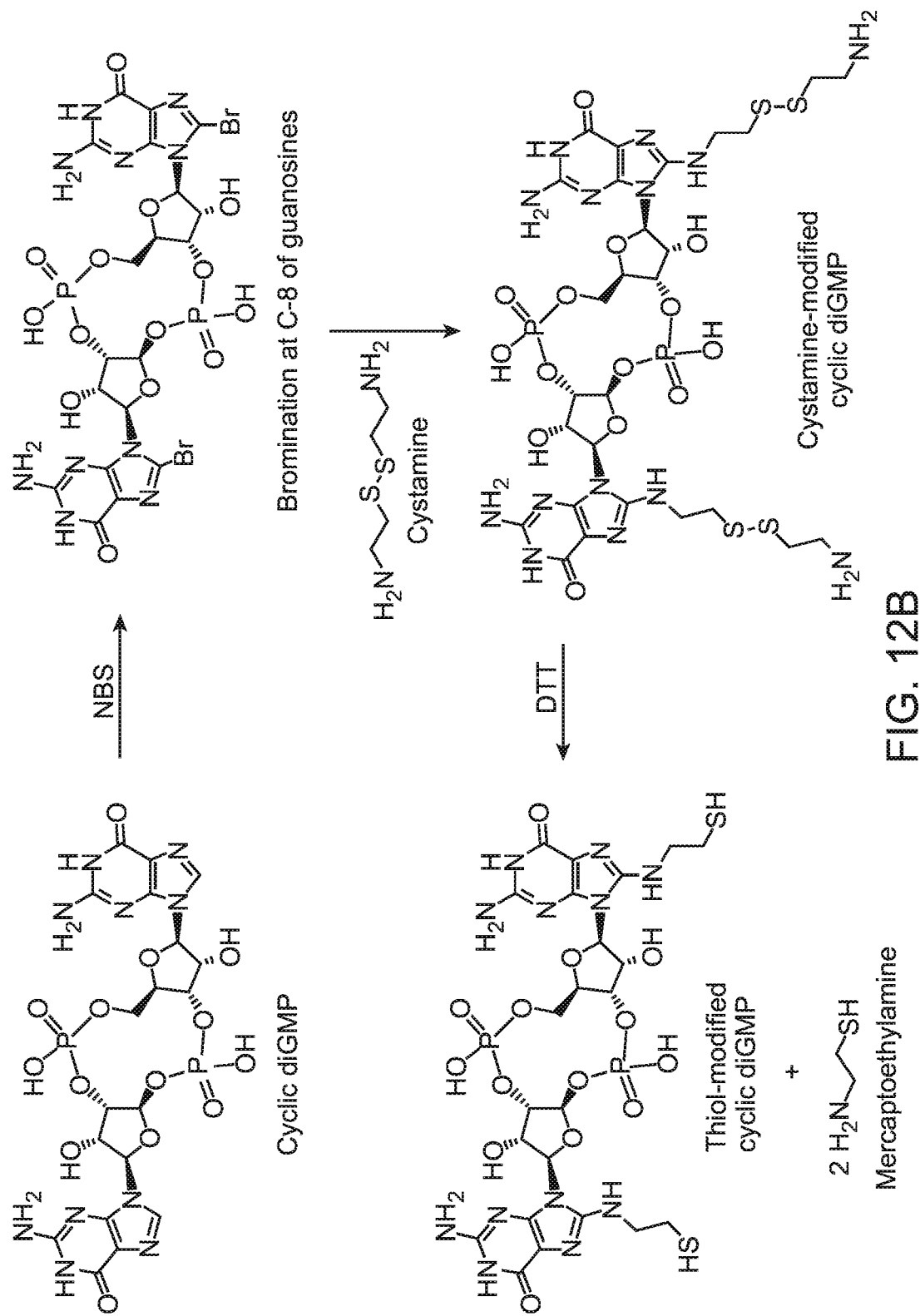
FIG. 12B illustrates the C-8 position on a 5 member ring comprising a purine base within a CDN, which can be brominated with an N-bromosuccinimide (NBS) to provide a reactive bromine group. This bromine group serve as a reactive group for coupling with an amine-containing group comprising a functional handle, for example, a thiol or a protected amine.

Alternatively, the C-8 position on the 5 member ring of a purine base within a CDN can be brominated with N-bromosuccinimide (NBS) to provide a reactive bromine group. The reactive bromine group is then coupled with an amine-containing group containing a functional group, such as a thiol, or a protected amine that is available for further coupling (FIG. 12B).

One or two functional groups are incorporated on the cyclic dinucleotide by, for example, having one or two phosphorothiolate linkages in the structure or having one or two guanosines (as adenosine will be less reactive with NBS).

Example 12

Figure 13:
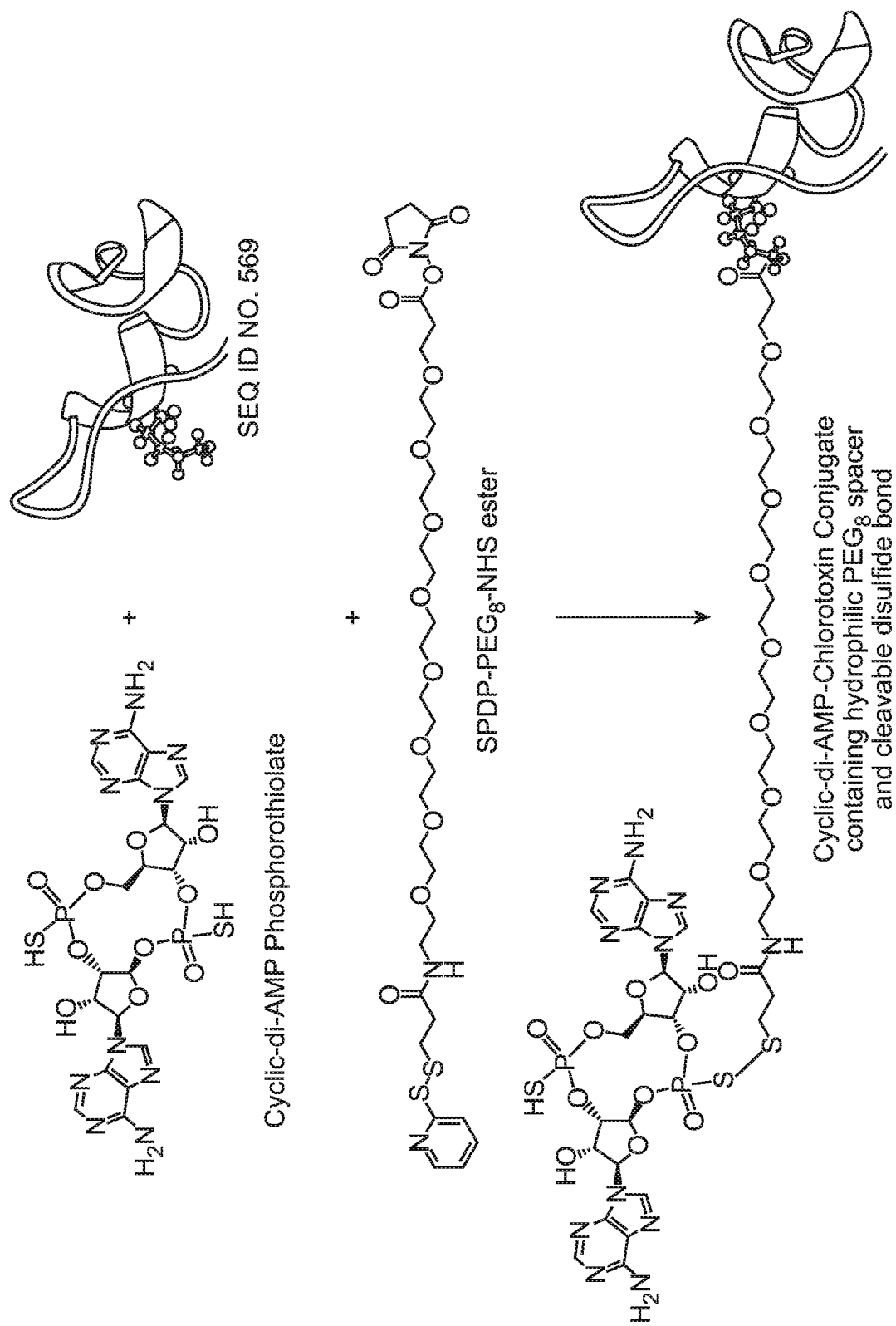
FIG. 13 illustrates generation of a cleavable disulfide linkage between a peptide (e.g., chlorotoxin or chlorotoxin derivative peptide) and a cyclic dinucleotide.

Generation of Cleavable Linkers Between RNA, DNA, or a Cyclic Dinucleotide with a Peptide This example describes generation of cleavable linkers between RNA, DNA, or a cyclic dinucleotide with any one of peptides of SEQ ID NO: 1-SEQ ID NO: 1134, SEQ ID NO: 1243-SEQ ID NO: 1262, or SEQ ID NO: 1263-SEQ ID NO: 1316. A disulfide linker is generated by combining a thiol-containing RNA/DNA/cyclic dinucleotide with a peptide comprising a free thiol group. The thiol is incorporated on the peptide using Traut's reagent, SATA, SPDP or other appropriate reagents on a reactive amine (such as a heterobifunctional SPDP and NHS ester linker with the N-terminus or a lysine residue), or by incorporating a free cysteine residue in the peptide (FIG. 13). The disulfide linker is cleaved in the reducing environment of the cytoplasm or in the endosomal/lysosomal pathway.

An ester linkage is generated by combining a free hydroxyl group (such as on the 3' end of an RNA or DNA, or on a ribose unit within a cyclic dinucleotide) with a carboxylic acid group on the peptide (such as from the C-terminus, an aspartic acid, glutamic acid residue, or introduced via a linker to a lysine residue or the N-terminus) such as via Fisher esterification or via use of an acyl chloride. The ester linker is cleaved by hydrolysis, which is accelerated by the lower pH of endosomes and lysosomes, or by enzymatic esterase cleavage.

An oxime or hydrazone linkage is generated by combining an aldehyde group on the RNA/DNA/cyclic dinucleotide with a peptide that has been functionalized with an aminooxy group (to form an oxime linkage) or a hydrazide group (to form a hydrazone linkage). The stability or lability of an oxime or hydrazone linkage is tailored by neighboring groups (Kalia et al., Angew Chem Int Ed Engl. 2008; 47(39):7523-6.), and hydrolytic cleavage is accelerated in acidic compartments such as the endosome/lysosome.

A hydrazide group is incorporated on a peptide by reacting adipic acid dihydrazide or carbohydrazide with carboxylic acid groups in the C-terminus or in aspartic or glutamic acid residues. An aminooxy group is incorporated on a peptide by reacting the N-terminus or a lysine residue with a heterobifunctional molecule containing an NHS ester on one end and a phthalimidoxy group on the other end, followed by cleavage with hydrazine. The reaction is, optionally, catalyzed by addition of aniline.

The cleavage rate of any linker is tuned, for example, by modifying the electron density in the vicinity of the cleavable link or by sterically affecting access to the cleavage site (e.g., by adding bulky groups, such as methyl groups, ethyl groups, or cyclic groups).

Cleavable linkers are, alternatively, generated using methods set forth in Bioconjugate Techniques, by Greg Hermanson, 3rd edition.

Installation of a thiol, amine, or aldehyde groups in RNA or DNA, as a functional handle, is carried out as described above in EXAMPLE 10. Installation of a carboxylate, thiol, or amine groups in cyclic dinucleotides, as a functional handle, is carried out as described above in EXAMPLE 11.

Figure 34:
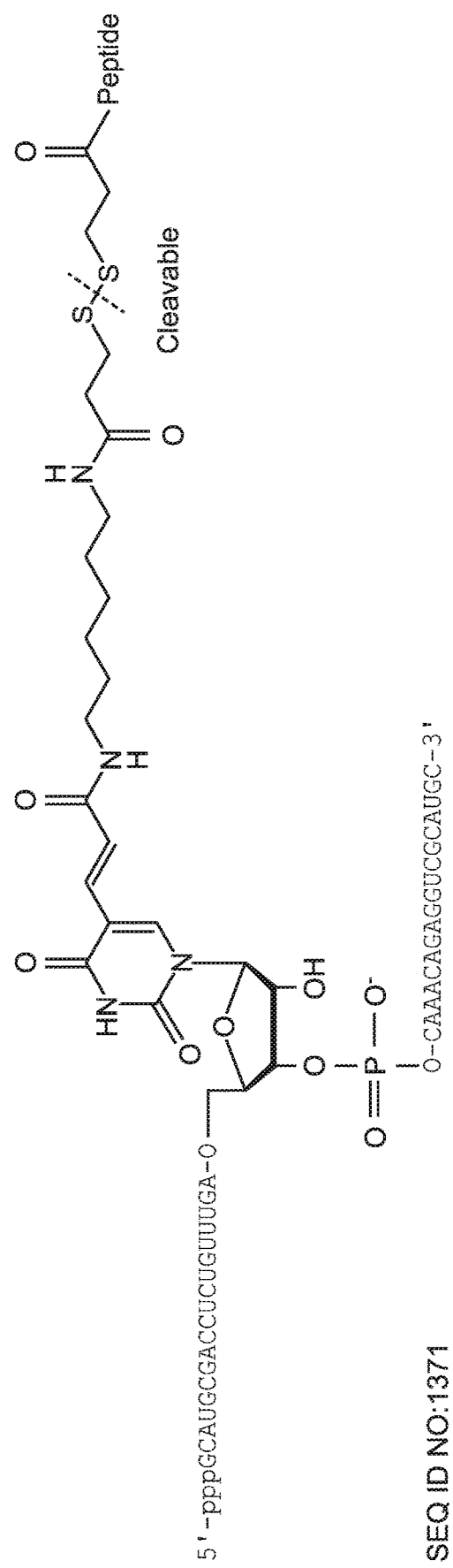
FIG. 34 illustrates a peptide-I/O complex comprising a peptide of SEQ ID NO: 568 and an I/O comprising a dsRNA (SEQ ID NO: 1371), linked together by a disulfide cleavable linker, where the linker is attached to a modified base in the dsRNA used as a conjugation or linkage site (e.g., as shown in the FIG. a uridine in SEQ ID NO: 1371 is modified to be uridine with an extended amine attached to the linker, which linker is also attached to the peptide [as denoted]). Note the dsRNA of SEQ ID NO: 1371 in this peptide-I/O complex has a 5'ppp (triphosphate) and is formed as a hairpin structure.
Figure 35:
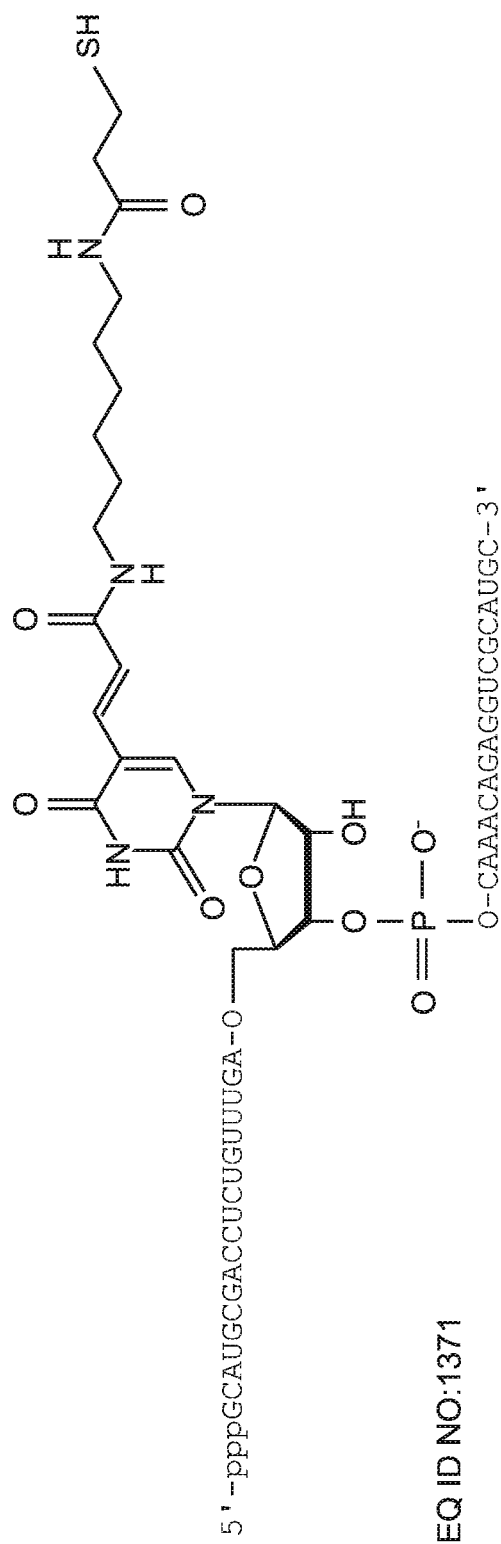
FIG. 35 illustrates the disulfide cleavage product of a peptide of the peptide-I/O complex of FIG. 34.

Exemplary peptide-RNA conjugates are given in FIG. 34-FIG. 35 and FIG. 39-FIG. 44. FIG. 34 illustrates a peptide-I/O complex comprising a peptide of SEQ ID NO: 568 and an I/O comprising a dsRNA (SEQ ID NO: 1371), linked together by a disulfide cleavable linker, where the linker is attached to a modified base in the dsRNA used as a conjugation or linkage site (e.g., as shown in the FIG. a uridine in SEQ ID NO: 1371 is modified to be uridine with an extended amine attached to the linker, which linker is also attached to the peptide [as denoted]). Note the dsRNA of SEQ ID NO: 1371 in this peptide-I/O complex has a 5'ppp (triphosphate) and is formed as a hairpin structure. FIG. 35 illustrates the cleavage product of a peptide of the peptide-I/O complex of FIG. 34.

Figure 39:
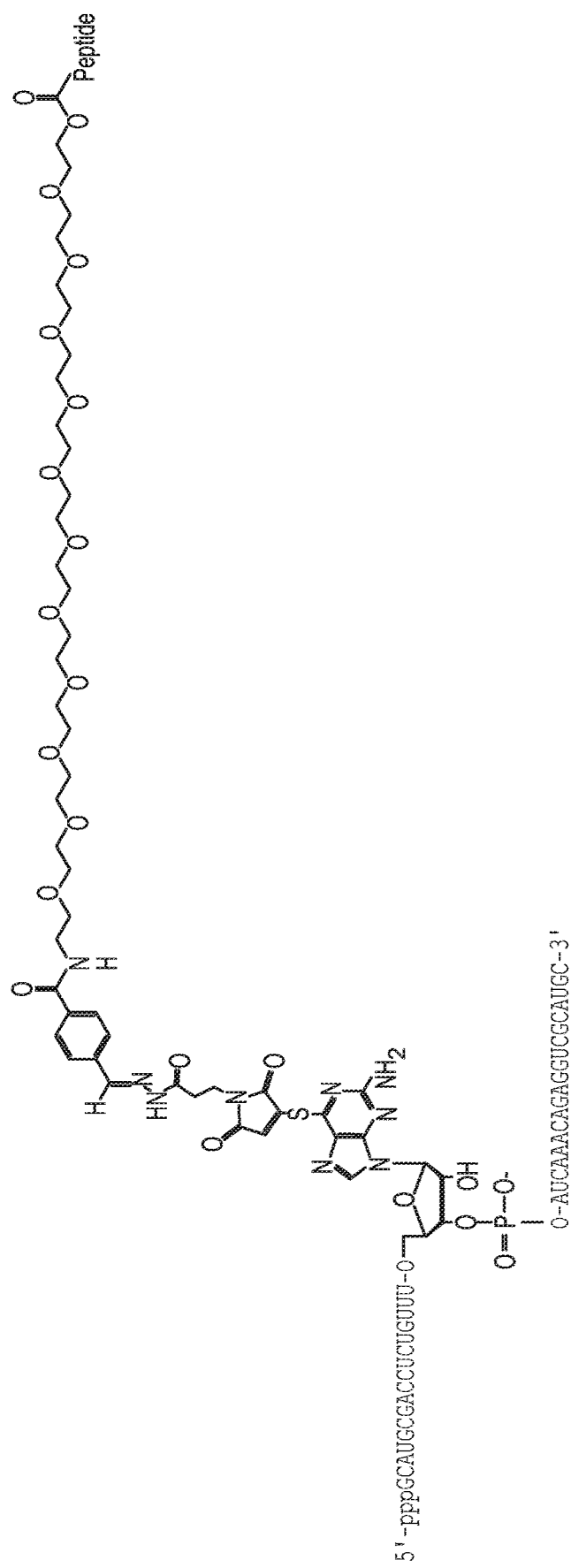
FIG. 39 illustrates a peptide-I/O complex comprising a peptide of SEQ ID NO: 569 and an I/O comprising a dsRNA (SEQ ID NO: 1371), linked together by a hydrazone/PEG linker, where the linker is attached to a modified base in the dsRNA used as a conjugation or linkage site (e.g., as shown in the figure, a guanosine in SEQ ID NO: 1371 is a modified guanosine attached to the linker, and the linker is also attached to the peptide (as denoted)). The dsRNA of SEQ ID NO: 1371 in this peptide-I/O complex has a 5'ppp (triphosphate) and is formed as a hairpin structure.
Figure 40:
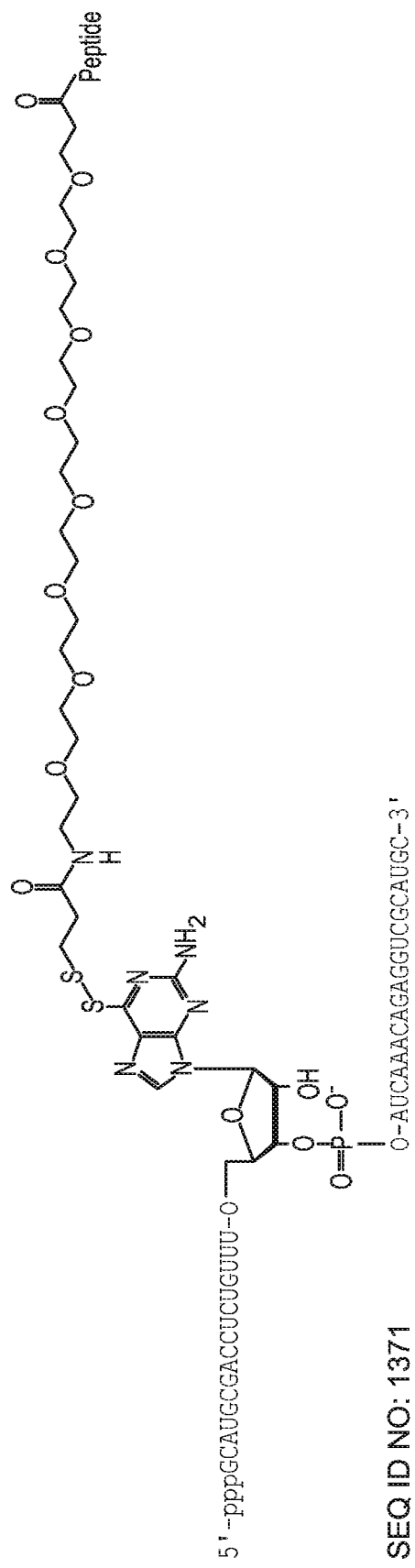
FIG. 40 illustrates a peptide-I/O complex comprising a peptide of SEQ ID NO: 569 and an I/O comprising a dsRNA (SEQ ID NO: 1371), linked together by a disulfide/PEG linker, where the linker is attached to a modified base in the dsRNA used as a conjugation or linkage site (e.g., as shown in the figure, a guanosine in SEQ ID NO: 1371 is a modified guanosine attached to the linker, and the linker is also attached to the peptide (as denoted)). The dsRNA of SEQ ID NO: 1371 in this peptide-I/O complex has a 5'ppp (triphosphate) and is formed as a hairpin structure.
Figure 41:
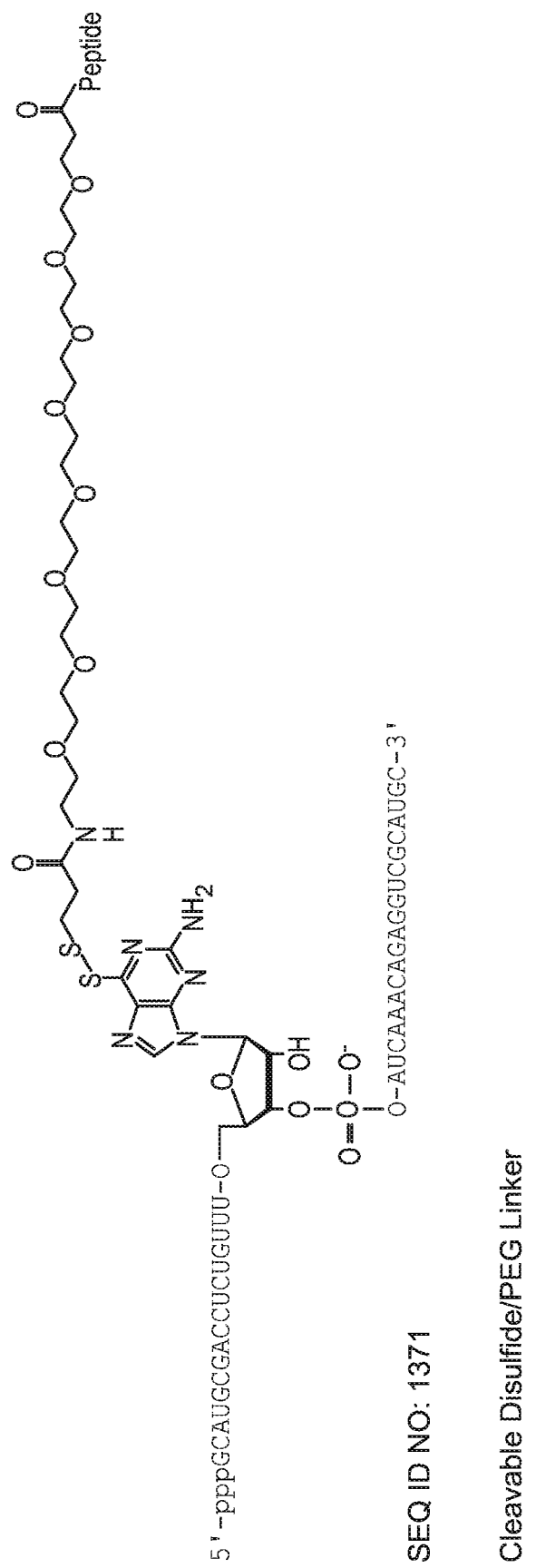
FIG. 41 illustrates a peptide-I/O complex comprising a peptide of SEQ ID NO: 569 conjugated to an ICG dye and an I/O comprising a dsRNA (SEQ ID NO: 1371), linked together by a disulfide/PEG linker, where the linker is attached to a modified base in the dsRNA used as a conjugation or linkage site (e.g., as shown in the figure, a guanosine in SEQ ID NO: 1371 is a modified guanosine attached to the linker, and the linker is also attached to the peptide (as denoted)). The dsRNA of SEQ ID NO: 1371 in this peptide-I/O complex has a 5'ppp (triphosphate) and is formed as a hairpin structure.
Figure 42:
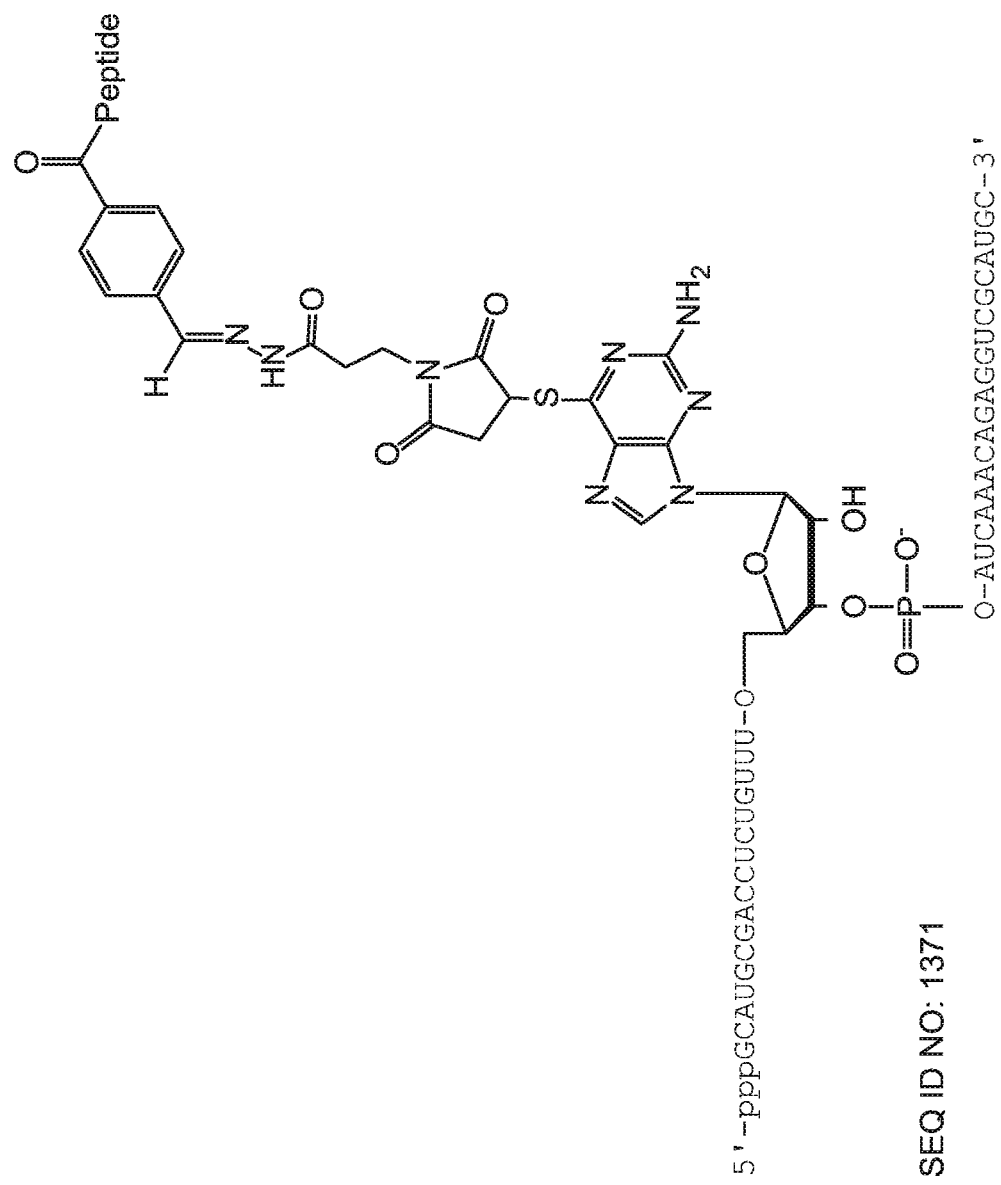
FIG. 42 illustrates a peptide-I/O complex comprising a peptide of SEQ ID NO: 569 and an I/O comprising a dsRNA (SEQ ID NO: 1371), linked together by a hydrazone linker, where the linker is attached to a modified base in the dsRNA used as a conjugation or linkage site (e.g., as shown in the figure, a guanosine in SEQ ID NO: 1371 is a modified guanosine attached to the linker, and the linker is also attached to the peptide (as denoted). The dsRNA of SEQ ID NO: 1371 in this peptide-I/O complex has a 5'ppp (triphosphate) and is formed as a hairpin structure.
Figure 43:
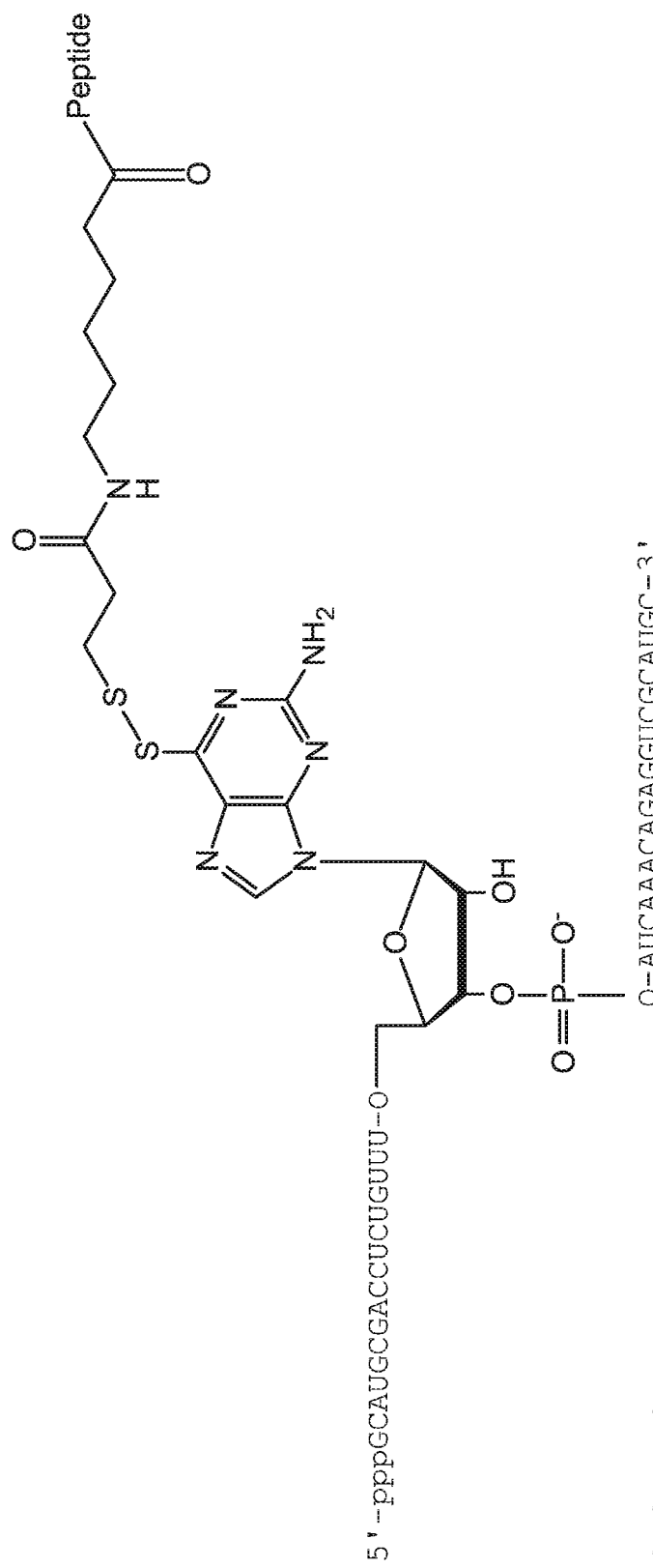
FIG. 43 illustrates a peptide-I/O complex comprising a peptide of SEQ ID NO: 569 and an I/O comprising a dsRNA (SEQ ID NO: 1371), linked together by a long disulfide linker, where the linker is attached to a modified base in the dsRNA used as a conjugation or linkage site (e.g., as shown in the figure, a guanosine in SEQ ID NO: 1371 is a modified guanosine attached to the linker, and the linker is also attached to the peptide (as denoted)). The dsRNA of SEQ ID NO: 1371 in this peptide-I/O complex has a 5'ppp (triphosphate) and is formed as a hairpin structure.
Figure 44:
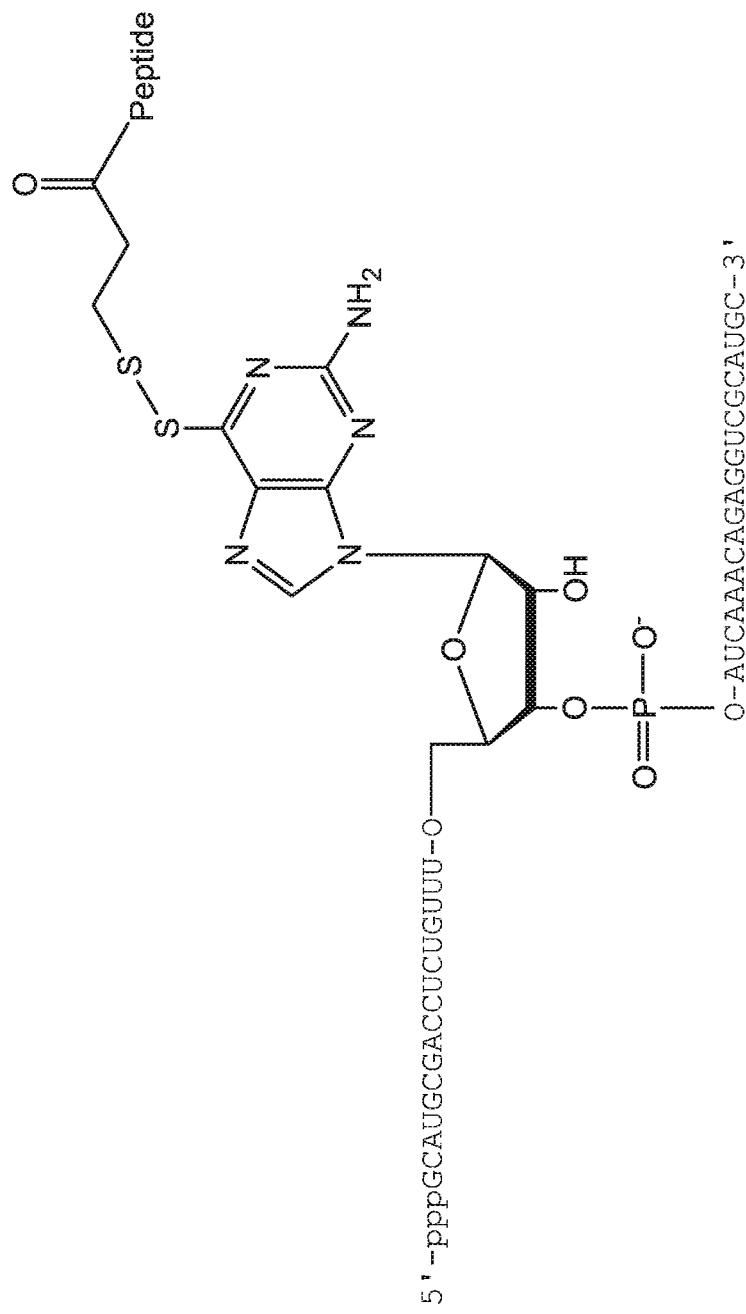
FIG. 44 illustrates a peptide-I/O complex comprising a peptide of SEQ ID NO: 569 and an I/O comprising a dsRNA (SEQ ID NO: 1371), linked together by a short disulfide linker, where the linker is attached to a modified base in the dsRNA used as a conjugation or linkage site (e.g., as shown in the figure, a guanosine in SEQ ID NO: 1371 is a modified guanosine attached to the linker, which linker is also attached to the peptide (as denoted)). The dsRNA of SEQ ID NO: 1371 in this peptide-I/O complex has a 5'ppp (triphosphate) and is formed as a hairpin structure.

FIG. 39 illustrates a peptide-I/O complex comprising a peptide of SEQ ID NO: 569 and an I/O comprising a dsRNA (SEQ ID NO: 1371), linked together by a hydrazone/PEG linker, where the linker is attached to a modified base in the dsRNA used as a conjugation or linkage site (e.g., as shown in the figure, a guanosine in SEQ ID NO: 1371 is a modified guanosine attached to the linker, and the linker is also attached to the peptide (as denoted)). The dsRNA of SEQ ID NO: 1371 in this peptide-I/O complex has a 5'ppp (triphosphate) and is formed as a hairpin structure. FIG. 40 illustrates a peptide-I/O complex comprising a peptide of SEQ ID NO: 569 and an I/O comprising a dsRNA (SEQ ID NO: 1371), linked together by a disulfide/PEG linker, where the linker is attached to a modified base in the dsRNA used as a conjugation or linkage site (e.g., as shown in the figure, a guanosine in SEQ ID NO: 1371 is a modified guanosine attached to the linker, and the linker is also attached to the peptide (as denoted)). The dsRNA of SEQ ID NO: 1371 in this peptide-I/O complex has a 5'ppp (triphosphate) and is formed as a hairpin structure. FIG. 41 illustrates a peptide-I/O complex comprising a peptide of SEQ ID NO: 569 conjugated to an ICG dye and an I/O comprising a dsRNA (SEQ ID NO: 1371), linked together by a disulfide/PEG linker, where the linker is attached to a modified base in the dsRNA used as a conjugation or linkage site (e.g., as shown in the figure, a guanosine in SEQ ID NO: 1371 is a modified guanosine attached to the linker, and the linker is also attached to the peptide (as denoted)). The dsRNA of SEQ ID NO: 1371 in this peptide-I/O complex has a 5'ppp (triphosphate) and is formed as a hairpin structure. FIG. 42 illustrates a peptide-I/O complex comprising a peptide of SEQ ID NO: 569 and an I/O comprising a dsRNA (SEQ ID NO: 1371), linked together by a hydrazone linker, where the linker is attached to a modified base in the dsRNA used as a conjugation or linkage site (e.g., as shown in the figure, a guanosine in SEQ ID NO: 1371 is a modified guanosine attached to the linker, and the linker is also attached to the peptide (as denoted). The dsRNA of SEQ ID NO: 1371 in this peptide-I/O complex has a 5'ppp (triphosphate) and is formed as a hairpin structure. FIG. 43 illustrates a peptide-I/O complex comprising a peptide of SEQ ID NO: 569 and an I/O comprising a dsRNA (SEQ ID NO: 1371), linked together by a long disulfide linker, where the linker is attached to a modified base in the dsRNA used as a conjugation or linkage site (e.g., as shown in the figure, a guanosine in SEQ ID NO: 1371 is a modified guanosine attached to the linker, and the linker is also attached to the peptide (as denoted)). The dsRNA of SEQ ID NO: 1371 in this peptide-I/O complex has a 5'ppp (triphosphate) and is formed as a hairpin structure. FIG. 44 illustrates a peptide-I/O complex comprising a peptide of SEQ ID NO: 569 and an I/O comprising a dsRNA (SEQ ID NO: 1371), linked together by a short disulfide linker, where the linker is attached to a modified base in the dsRNA used as a conjugation or linkage site (e.g., as shown in the figure, a guanosine in SEQ ID NO: 1371 is a modified guanosine attached to the linker, which linker is also attached to the peptide (as denoted)). The dsRNA of SEQ ID NO: 1371 in this peptide-I/O complex has a 5'ppp (triphosphate) and is formed as a hairpin structure.

A peptide-I/O complex of FIG. 34 was generated synthetically, purified, and the mass was verified by MALDI-TOF MS and purity was measured by RP-HPLC.

Example 13

Generation of Stable Linkers Between RNA, DNA, or a Cyclic Dinucleotide with a Peptide This example describes generation of a stable linkers between RNA, DNA, or a cyclic dinucleotide, such as RIG-I ligands or STING ligands, with any one of peptides of SEQ ID NO: 1-SEQ ID NO: 1134, SEQ ID NO: 1243-SEQ ID NO: 1262, or SEQ ID NO: 1263-SEQ ID NO: 1316. A stable linker through a secondary amine is generated by reductive amination, achieved by combining an aldehyde-containing RNA, DNA, or cyclic dinucleotide with the amine at the N-terminus of a peptide or in a lysine residue, followed by reduction with sodium cyanoborohydride.

A stable amide linkage is generated by combining an amine group on an RNA, DNA, or cyclic dinucleotide with the carboxylate at the C-terminus of a peptide or in an aspartic acid or glutamic acid residues.

A stable carbamate linkage is generated by activating a hydroxyl group in an RNA, DNA, or cyclic dinucleotide with carbonyldiimidazole (CDI) or N,N'-disuccinimidyl carbonate (DSC) and subsequently reacted with a peptide's N-terminus or lysine residue.

A maleimide linker is created by combining a thiol-containing RNA, DNA, or cyclic dinucleotide with a maleimide functionalized peptide. The peptide is functionalized using an NHS-X-maleimide heterobifunctional agent on a reactive amine in the peptide, wherein X is any linker. A maleimide linker is used as a stable linker or as a slowly cleavable linker, which is cleaved by exchange with other thiol-containing molecules in biological fluids. The maleimide linker is also stabilized by hydrolyzing the succinimide moiety of the linker using various substituents, including those described in Fontaine et al., Bioconjugate Chem., 2015, 26 (1), pp 145-152.

Other methods of incorporating, adding, or modifying functional groups in polynucleotides, for example, are carried out using techniques set forth in Bioconjugate Techniques, by Greg Hermanson, 3rd edition.

Installation of a thiol, amine, or aldehyde groups in RNA or DNA, as a functional handle, is carried out as described above in EXAMPLE 10. Installation of a carboxylate, thiol, or amine groups in cyclic dinucleotides, as a functional handle, is carried out as described above in EXAMPLE 11.

Figure 36:
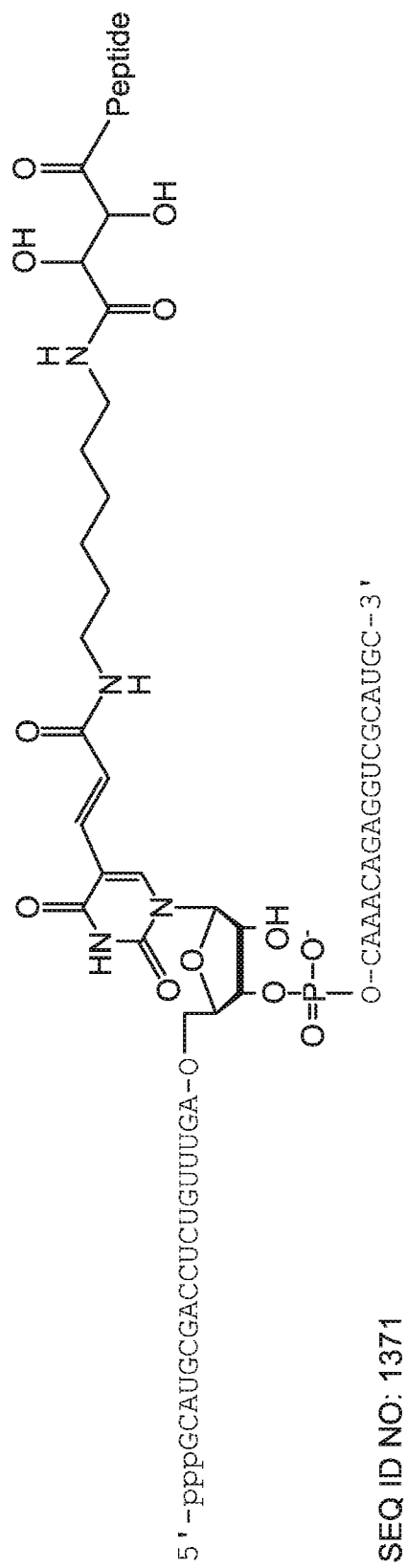
FIG. 36 illustrates a peptide-I/O complex comprising a peptide of SEQ ID NO: 568 and an I/O comprising a dsRNA (SEQ ID NO: 1371), linked together by an extended stable linker, where the linker is attached to a modified base in the dsRNA used as a conjugation or linkage site (e.g., as shown in the figure, a uridine in SEQ ID NO: 1371 is modified to be uridine with an extended amine attached to the linker, and the linker is also attached to the peptide (as denoted)). The dsRNA of SEQ ID NO: 1371 in this peptide-I/O complex has a 5'ppp (triphosphate) and is formed as a hairpin structure.
Figure 37:
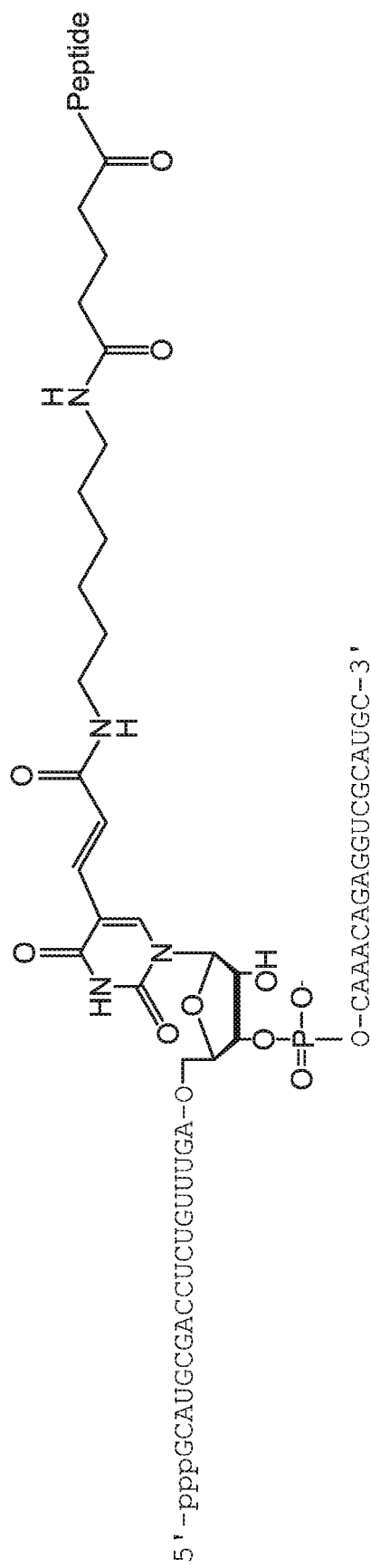
FIG. 37 illustrates a peptide-I/O complex comprising a peptide of SEQ ID NO: 569 and an I/O comprising a dsRNA (SEQ ID NO: 1371), linked together by an extended stable linker, where the linker is attached to a modified base in the dsRNA used as a conjugation or linkage site (e.g., as shown in the figure, a uridine in SEQ ID NO:1371 is modified to be uridine with an extended amine attached to the linker, and the linker is also attached to the peptide (as denoted)). The dsRNA of SEQ ID NO: 1371 in this peptide-I/O complex has a 5'ppp (triphosphate) and is formed as a hairpin structure.
Figure 38:
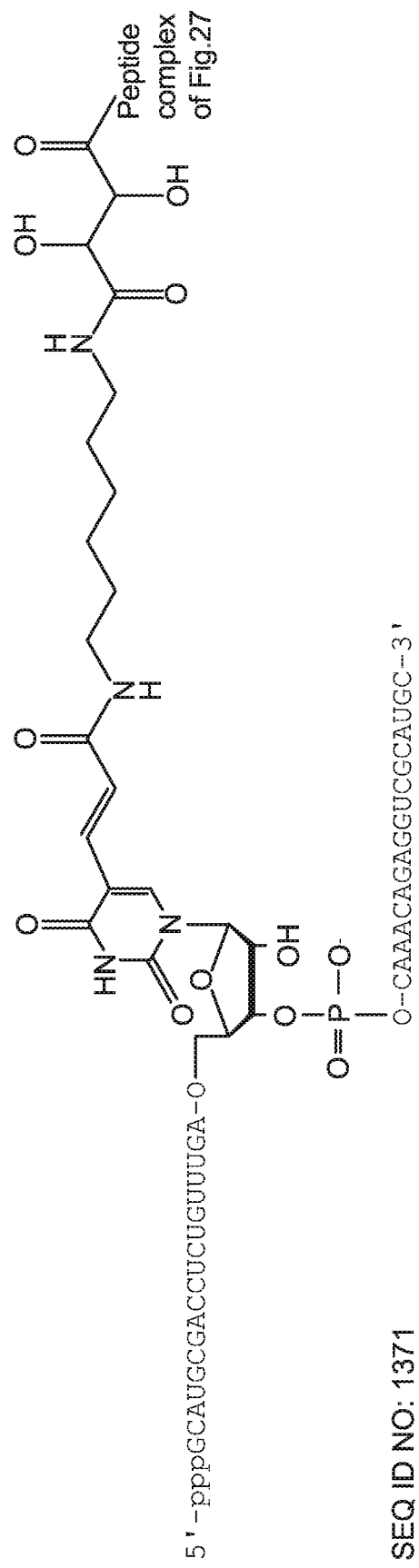
FIG. 38 illustrates a peptide-I/O complex comprising a peptide of SEQ ID NO: 569 conjugated to an ICG dye (see the peptide complex of FIG. 27) and an I/O comprising a dsRNA (SEQ ID NO:1371), linked together with an extended stable linker, where the linker is attached to a modified base in the dsRNA used as a conjugation or linkage site (e.g., as shown in the figure, a uridine in SEQ ID NO:1371 is modified to be uridine with an extended amine attached to the linker, and the linker is also attached to the peptide (as denoted)). The dsRNA of SEQ ID NO: 1371 in this peptide-I/O complex has a 5'ppp (triphosphate) and is formed as a hairpin structure.

Exemplary stable peptide-I/O complexes comprising RNA I/Os are shown in FIG. 36-FIG. 38. The peptide-I/O complexes shown in FIG. 36-FIG. 38 were generated synthetically and purified. Their masses were verified by MALDI-TOF MS and purity was measured by RP-HPLC. FIG. 36 illustrates a peptide-I/O complex comprising a peptide of SEQ ID NO: 568 and an I/O comprising a dsRNA (SEQ ID NO: 1371), linked together by an extended stable linker, where the linker is attached to a modified base in the dsRNA used as a conjugation or linkage site (e.g., as shown in the figure, a uridine in SEQ ID NO: 1371 is modified to be uridine with an extended amine attached to the linker, and the linker is also attached to the peptide (as denoted)). The dsRNA of SEQ ID NO: 1371 in this peptide-I/O complex has a 5'ppp (triphosphate) and is formed as a hairpin structure. FIG. 37 illustrates a peptide-I/O complex comprising a peptide of SEQ ID NO: 569 and an I/O comprising a dsRNA (SEQ ID NO: 1371), linked together by an extended stable linker, where the linker is attached to a modified base in the dsRNA used as a conjugation or linkage site (e.g., as shown in the figure, a uridine in SEQ ID NO:1371 is modified to be uridine with an extended amine attached to the linker, and the linker is also attached to the peptide (as denoted)). The dsRNA of SEQ ID NO: 1371 in this peptide-I/O complex has a 5'ppp (triphosphate) and is formed as a hairpin structure. FIG. 38 illustrates a peptide-I/O complex comprising a peptide of SEQ ID NO: 569 conjugated to an ICG dye (see the peptide complex of FIG. 27) and an I/O comprising a dsRNA (SEQ ID NO:1371), linked together with an extended stable linker, where the linker is attached to a modified base in the dsRNA used as a conjugation or linkage site (e.g., as shown in the figure, a uridine in SEQ ID NO:1371 is modified to be uridine with an extended amine attached to the linker, and the linker is also attached to the peptide (as denoted)). The dsRNA of SEQ ID NO: 1371 in this peptide-I/O complex has a 5'ppp (triphosphate) and is formed as a hairpin structure.

Example 14

Generation of a Boronic Ester Linkage Between RNA and Peptide

This example describes generation of a boronic ester linkage between RNA, such as a RIG-I ligand or an MDA5 ligand, and any one of peptides of SEQ ID NO: 1-SEQ ID NO: 1134, SEQ ID NO: 1243-SEQ ID NO: 1262, or SEQ ID NO: 1263-SEQ ID NO: 1316. Phenylboronic acids (PBAs) form reversible covalent complexes with cis diols. A cleavable linker is formed by creating a covalent complex between the diol on the 3' end of RNA and a PBA-containing peptide. A PBA group is incorporated on a peptide by reacting 4-formyl-PBA with the N-terminus or a lysine in a peptide via reductive amination. The pKa of the PBA is modulated by neighboring groups (e.g., amines) to lower the pKa to ~6, allowing complexation at neutral pH and release at lower pH. (Aguirre-Chagala et al., ACS Macro Lett., 2014, 3 (12), pp 1249-1253; Winblade et al., Biomacromolecules. 2000 Winter; 1(4):523-33; Roy et al., ACS Macro Lett., 2012, 1 (5), pp 529-532; Gennari et al., Bioconjugate Chem., 2017, 28 (5), pp 1391-1402). A boronic ester linkage is cleaved by the lower pH environment of the endosome/lysosome. After cleavage, the RNA is released in its unmodified form, resulting in traceless delivery of the RNA.

Example 15

Generation of an Enzyme Cleavable Linkage Between RNA, DNA, or a Cyclic Dinucleotide with a Peptide This example describes generation of an enzyme cleavable linkage between RNA, DNA, or a cyclic dinucleotide, such as a RIG-I ligand or a STING ligand, and any one of peptides of SEQ ID NO: 1-SEQ ID NO: 1134, SEQ ID NO: 1243-SEQ ID NO: 1262, or SEQ ID NO: 1263-SEQ ID NO: 1316. An enzymatically cleavable linkage is generated between an RNA, DNA, or a cyclic dinucleotide and a peptide. The conjugate with a cleavable linkage is administered in vitro or in vivo and is cleaved by enzymes in the cells or body, releasing the RNA, DNA, or cyclic dinucleotide. The enzyme is present in the endosome/lysome, the cytosol, the cell surface, or is upregulated in the tumor microenvironment. These enzymes include, but are not limited to, cathepsins (such as all those listed in Kramer et al., Trends Pharmacol Sci. 2017 October; 38(10):873-898) such as cathepsin B, glucuronidases including beta-glucuronidase, hyaluronidase and matrix metalloproteases, such as MMP-1, 2, 7, 9, 13, or 14 (Kessenbrock et al., Cell. 2010 Apr. 2; 141(1): 52-67). Cathepsin or MMPs cleave amino acid sequences of any one of SEQ ID NO: 1139-SEQ ID NO: 1161, SEQ ID NO: 1360-SEQ ID NO: 1363 and SEQ ID NO: 1365 shown below in TABLE 9 (see also Nagase, Hideaki. "Substrate specificity of MMPs." Matrix Metalloproteinase Inhibitors in Cancer Therapy. Humana Press, 2001. 39-66; Dal Corso et al., Bioconjugate Chem., 2017, 28 (7), pp 1826-1833; Dal Corso et al., Chemistry-A European Journal 21.18 (2015): 6921-6929; Doronina et al., Bioconjug Chem. 2008 October; 19(10):1960-3.). Glucuronidase linkers include any one of those described in Jeffrey et al., Bioconjugate Chem., 2006, 17 (3), pp 831-840.

TABLE 9

Enzymatically Cleavable Linkers

| SEQ ID NO | Sequence | Cleaved By |
| --- | --- | --- |
| SEQ ID NO: 1139 | Val-Ala | Cathepsin |
| SEQ ID NO: 1140 | Val-Lys | Cathepsin |
| SEQ ID NO: 1141 | Val-Arg | Cathepsin |
| SEQ ID NO: 1142 | Val-Cit | Cathepsin |
| SEQ ID NO: 1143 | Phe-Lys | Cathepsin |
| SEQ ID NO: 1144 | Met-Lys | Cathepsin |
| SEQ ID NO: 1145 | Asn-Lys | Cathepsin |
| SEQ ID NO: 1146 | Ile-Pro | Cathepsin |
| SEQ ID NO: 1147 | Gly-Ile | MMP |
| SEQ ID NO: 1148 | Gly-Leu | MMP |
| SEQ ID NO: 1149 | Gly-Tyr | MMP |
| SEQ ID NO: 1150 | Gly-Met | MMP |
| SEQ ID NO: 1151 | Met-Ile | MMP |
| SEQ ID NO: 1152 | Ala-Ile | MMP |
| SEQ ID NO: 1153 | Pro-Ile | MMP |
| SEQ ID NO: 1154 | Gly-Pro-Gln-Gly-Ile-Ala-Gly-Gln | MMP |
| SEQ ID NO: 1155 | Gly-Pro-Gln-Gly-Ile-Phe-Gly-Gln | MMP |
| SEQ ID NO: 1156 | Gly-Pro-Gln-Gly-Ile-Trp-Gly-Gln | MMP |
| SEQ ID NO: 1157 | Gly-Pro-Gln-Gly-Ile-Leu-Gly-Gln | MMP |
| SEQ ID NO: 1158 | Gly-Pro-Gln-Gly-Ile-Arg-Gly-Gln | MMP |
| SEQ ID NO: 1159 | Gly-Pro-Leu-Gly-Ile-Ala-Gly-Gln | MMP |
| SEQ ID NO: 1160 | Gly-Pro-Met-Gly-Ile-Ala-Gly-Gln | MMP |
| SEQ ID NO: 1161 | Gly-Pro-Tyr-Gly-Ile-Ala-Gly-Gln | MMP |
| SEQ ID NO: 1360 | GSVAGS | |
| SEQ ID NO: 1361 | GGGGSVAGGGGS | |
| SEQ ID NO: 1362 | GGGGSGGGGSVAGGGGSGGGGS | |
| SEQ ID NO: 1363 | GGGGSGGGGSPLGLAGGGGSGGGGS | |
| SEQ ID NO: 1365 | AEAAAKEAAAKAVAAEAAAKEAAAKA | |

A Val-Cit-PABC enzymatically cleavable linker, such as described in Jain et al., Pharm Res. 2015 November; 32(11): 3526-40., is created by conjugating the PABC end to an amine group on the RNA, DNA, or cyclic dinucleotide. The valine end is further linked to the peptide, for example, by generating an amide bond to the C-terminus of the peptide. A spacer on either side of the molecule is optionally incorporated in order to facilitate steric access of the enzyme to the Val-Cit linkage (SEQ ID NO: 1142). The linkage to the peptide is, alternatively, generated by activating the N-terminus of the peptide with SATA and creating a thiol group, which is subsequently reacted to a maleimidocaproyl group attached to the N-terminus of the Val-Cit pair (SEQ ID NO: 1142). Upon cleavage by cathepsin B, the self-immolative PABC group spontaneously eliminates, releasing the amine-containing RNA, DNA, or cyclic dinucleotide with no further chemical modifications. Other amino acid pairs include Glu-Glu, Glu-Gly, and Gly-Phe-Leu-Gly (SEQ ID NO: 1497).

Installation of a thiol, amine, or aldehyde groups in RNA or DNA, as a functional handle, is carried out as described above in EXAMPLE 10. Installation of a carboxylate, thiol, or amine groups in cyclic dinucleotides, as a functional handle, is carried out as described above in EXAMPLE 11.

Example 16

Conjugation of a RIG-I Ligand and a Peptide

This example describes conjugation of a RIG-I ligand to a peptide of the present disclosure. The peptide is SEQ ID NO: 2 or SEQ ID NO: 569 (SEQ ID NO: 2 without N-terminal GS). The RIG-I ligand shown in FIG. 2 and is synthesized using 2'-fluoropyrimidines to increase backbone stability. The Lys27 residue of SEQ ID NO: 569 (at position 29 in SEQ ID NO: 2) is conjugated via reductive amination to 4-formyl-PBA. The PBA-containing peptide is complexed to the 3' diol group of the RIG-I ligand to form a boronate ester.

Alternatively, the RIG-I ligand made with 2'-fluoropyrimidines has a thiol-containing or phosphorothiolate-containing nucleotide residue included in the sequence, during synthesis, distal to the 5'ppp, such as at least 10 base pairs away. Lys27 in SEQ ID NO: 569 (or Lys residue 29 in SEQ ID NO: 2) is modified with SATA (with subsequent deprotection using hydroxylamine) to form a thiol group.

Alternatively, Lys27 in SEQ ID NO: 569 (or Lys residue 29 in SEQ ID NO: 2) is modified with SPDP-PEG$_4$-NHS ester to form a protected thiol group, with a flexible hydrophilic PEG spacer. The two thiol groups in the modified RIG-I ligand and SEQ ID NO: 569 are combined to form a cleavable disulfide bond. Alternatively, Lys27 in SEQ ID NO: 569 (or Lys residue 29 in SEQ ID NO: 2) is modified with bromoacetamido-PEG$_4$-TFP ester to form an amide bond, and then reacted with the thiol group within the RIG-I ligand made with 2'-fluoropyrimidines, to form a stable thioether bond.

Alternatively, the RIG-I ligand made with 2'-fluoropyrimidines has an amine-containing nucleotide included in the sequence, during synthesis, distal to the 5'ppp. Lys27 in SEQ ID NO: 569 (at position 29 in SEQ ID NO: 2) is modified with SATA to form a thiol group. A maleimido-caproyl-Val-Cit-PABC linker is conjugated to the amine in the RIG-I ligand and to the thiol in SEQ ID NO: 2 or SEQ ID NO: 569.

Alternatively, the RIG-I ligand made with 2'-fluoropyrimidines is conjugated to Lys27 of SEQ ID NO: 569 (at position 29 in SEQ ID NO: 2) via reductive amination after oxidation of the 3' diols to form a secondary amine conjugate.

Alternatively, the RIG-I ligand made with 2'-fluoropyrimidines has the 3' end oxidized to aldehydes via periodate oxidation. The aldehyde is then reacted with the peptide of SEQ ID NO: 2, which is functionalized with an aminooxy group on the N-terminus to form a cleavable oxime bond.

Alternatively, the RIG-I ligand of SEQ ID NO: 1180 (sense) and SEQ ID NO: 1181 (antisense) is used using 2'-fluoropyrimidines to increase backbone stability. The 3' end of the sense strand is synthesized with a thiol modification as shown in FIG. 1. Lys27 in SEQ ID NO: 569 (or Lys residue 29 in SEQ ID NO: 2) is modified with bromoacetamido-PEG$_4$-TFP ester to form an amide bond, and then reacted with the thiol group within the RIG-I ligand to form a stable thioether bond. Alternatively the 5' end of the sense strand or amino terminated nucleotides serves as the site of modification.

Alternatively, the peptide is any one of SEQ ID NO: 1-SEQ ID NO: 1134, SEQ ID NO: 1243-SEQ ID NO: 1262, or SEQ ID NO: 1263-SEQ ID NO: 1316.

Installation of a thiol, amine, or aldehyde groups in RNA or DNA, as a functional handle, is carried out as described above in EXAMPLE 10. Installation of a carboxylate, thiol, or amine groups in cyclic dinucleotides, as a functional handle, is carried out as described above in EXAMPLE 11.

Example 17

Conjugation of a Cyclic Dinucleotide and a Peptide

This example describes conjugation of a cyclic dinucleotide to a peptide of the present disclosure. The peptide is SEQ ID NO: 2 or SEQ ID NO: 569 (SEQ ID NO: 2 without N-terminal GS). A hydroxyl group in 2'3' cGAMP is used to form an ester linkage with SEQ ID NO: 2 or SEQ ID NO: 569 by reacting the hydroxyl group with glutaric anhydride, subsequently making the NHS glutaric ester of the modified 2'3' cGAMP, followed by reaction with the amine in Lys27 of SEQ ID NO: 569 (at position 29 in SEQ ID NO: 2).

Alternatively, maleimidocaproyl-Val-Cit-PABC linker is conjugated to an amine in 2'3' cGAMP and to a thiol group in SEQ ID NO: 2 or SEQ ID NO: 569 (where Lys 27 (SEQ ID NO: 569) or Lys 29 (SEQ ID NO: 2) is reacted with SATA to form a thiol group).

Alternatively, a hydroxyl group in 2'3' cGAMP is used to form a carbamate linkage with SEQ ID NO: 2 or SEQ ID NO: 569 by activating the hydroxyl with DSC, and then reacting the resulting compound with the Lys27 residue of SEQ ID NO: 569 (at position 29 in SEQ ID NO: 2).

Alternatively, a cyclic dinucleotide from TABLE 8 comprising a phosphorothioate, such as ML-RR-S2-CDA, is used. Lys27 in SEQ ID NO: 569 (or Lys residue 29 in SEQ ID NO: 2) is modified with SPDP-PEG$_8$-NHS ester to form an amide bond, and then reacted with the phosphorothiolate group in the cyclic dinucleotide to form a cleavable disulfide bond.

Alternatively, a fusion product comprising one or more stable spacer peptides (such as any one of SEQ ID NO: 1164-SEQ ID NO: 1172), and/or an enzymatically cleavable peptide (such as any one of SEQ ID NO: 1139-SEQ ID NO: 1161, SEQ ID NO: 1360-SEQ ID NO: 1363 and SEQ ID NO: 1365), and a peptide of this disclosure, such as SEQ ID NO: 1170, SEQ NO: 1139, or SEQ ID NO: 2. This fusion product is functionalized with a bromoacetyl group on the N-terminus and the bromo group is reacted with the phosphorothiolate group in the cyclic dinucleotide to form an enzymatically cleavable linkage.

Alternatively, the C8 of guanosine of 2'3' cGAMP is brominated with NBS and reacted with cystamine and reduce to make a thiol. Lys27 in SEQ ID NO: 569 (or Lys residue 29 in SEQ ID NO: 2) is modified with SPDP-PEG$_4$-NHS ester to form an amide bond and reacted with the thiol group to form a cleavable disulfide bond.

Alternatively, the C8 of guanosine of 2'3' cGAMP is brominated with NBS. This is reacted with the N-terminus of a fusion product comprising one or more stable spacer peptides (such as any one of SEQ ID NO: 1163-SEQ ID NO: 1172 or any one of SEQ ID NO: 1359, SEQ ID NO: 1364, SEQ ID NO: 1366), and/or an enzymatically cleavable peptide (such as any one of SEQ ID NO: 1139-SEQ ID NO: 1161, SEQ ID NO: 1360-SEQ ID NO: 1363 and SEQ ID NO: 1365), and a peptide of this disclosure, such as SEQ NO: 1139, SEQ ID NO: 1170, and SEQ ID NO: 2.

Alternatively, the peptide is any one of SEQ ID NO: 1-SEQ ID NO: 1134, SEQ ID NO: 1243-SEQ ID NO: 1262, or SEQ ID NO: 1263-SEQ ID NO: 1316.

Installation of a thiol, amine, or aldehyde groups in RNA or DNA, as a functional handle, is carried out as described above in EXAMPLE 10. Installation of a carboxylate, thiol, or amine groups in cyclic dinucleotides, as a functional handle, is carried out as described above in EXAMPLE 11.

Example 18

Expression of an IL-15 Hyperagonist Fused with a Tumor Homing and/or Cell Penetrating Peptide This example describes expression and purification of an IL-15 agent comprising an IL-15 hyperagonist, fused to any tumor homing and/or cell penetrating peptide of this disclosure, such as any one of SEQ ID NO: 1-SEQ ID NO: 1134, SEQ ID NO: 1243-SEQ ID NO: 1262, or SEQ ID NO: 1263-SEQ ID NO: 1316. The peptide is fused to the N-terminus or the C-terminus of the IL-15 hyperagonist. The IL-15 hyperagonist is comprised of IL-15Ra, a linker, and IL-15 (referred to as an exemplary "RLI" from the N to C-terminus direction; SEQ ID NO: 1135), or is comprised of IL-15, a linker, and IL-15Ra (referred to as an exemplary "ILR). Examples of IL-15 hyperagonists are shown in TABLE 3. The IL-15 hyperagonist and the peptide are linked via an enzymatically cleavable linker, such as a linker cleaved by cathepsins or MMP. The enzymatically cleavable linker is any one of SEQ ID NO: 1139-SEQ ID NO: 1161, SEQ ID NO: 1360-SEQ ID NO: 1363 and SEQ ID NO: 1365. Alternatively, or in addition, the IL-15 hyperagonist and the peptide are linked via a stable linker, such as a linker of any one of SEQ ID NO: 1163-SEQ ID NO: 1168, as shown below in TABLE 10 or other stable linkers. A tag useful for labeling or purification, such as FLAG, is optionally added to the fusion. Said tag can be linked with a linker that is enzymatically cleaved after purification, such as "Xa." A FLAG-Xa (DYKDDDDKIEGR) tag is shown in SEQ ID NO: 1162.

The peptide can be a peptide of SEQ ID NO: 1, SEQ ID NO: 2, SEQ ID NO: 568, or SEQ ID NO: 569, or any peptide that is 80%, 85%, 90%, 95%, 96%, 97%, 98%, 99% or more identical to any of the foregoing. From the N-terminus to the C-terminus, an example fusion peptide with an enzymatically cleavable linker is (1) SEQ ID NO: 1135 or SEQ ID NO: 1136, (2) SEQ ID NO: 1170, (3) SEQ ID NO: 1139 or SEQ ID NO: 1147, and (4) SEQ ID NO: 1. From the N-terminus to the C-terminus, an example fusion peptide with a stable linker is (1) SEQ ID NO: 1135 or SEQ ID NO: 1136, (2) SEQ ID NO: 1170, and (3) SEQ ID NO: 1.

TABLE 10

Stable Linkers

| SEQ ID NO | Sequence |
| --- | --- |
| SEQ ID NO: 1163 | GGSGGGGSGGGSGGGGSLQ |
| SEQ ID NO: 1164 | GGSGGGGSGGGSGGGGS |
| SEQ ID NO: 1165 | SGGGSGGGGSGGGGSGGGGSGGGSLQ |
| SEQ ID NO: 1166 | SGGGSGGGGSGGGGSGGGGSGGGS |
| SEQ ID NO: 1167 | (GGGGS)x; where x = 1-10 |
| SEQ ID NO: 1168 | GS |
| SEQ ID NO: 1169 | SGGSGGGGSGGGSGGGGSLQ |
| SEQ ID NO: 1170 | GGGS |
| SEQ ID NO: 1171 | GGGSGGGS |
| SEQ ID NO: 1172 | (GGGS)x; where x = 1-10 |
| SEQ ID NO: 1359 | GGGGSGGGGSGGGGS |
| SEQ ID NO: 1364 | AEAAAKEAAAKEAAAKA |
| SEQ ID NO: 1366 | SGGSGGGGSGGGGSGGGGSGGGSLQ |

The peptide-protein fusion is expressed recombinantly in cells or in a cell-free system using standard molecular biology techniques, such as those described in M. R. Green, Joseph Sambrook. Molecular Cloning. 2012 Cold Spring Harbor Press. For instance, DNA is synthesized that encodes for the designed polypeptide, as well as a leader peptide and other elements necessary for expression. The construct is inserted into an expression vector, which is recombined in a virus used to transfect cells, such as CHO mammalian cells or SF9 insect cells. The protein is expressed and purified. Alternatively, the IL15 hyperagonist is chemically conjugated to the tumor homing and/or cell penetrating peptide, using bioconjugate chemistries described in Bioconjugate Techniques by Hermanson.

Other peptide-I/O complexes can similarly exhibit tumor homing, such as peptide-IL-15 agent complexes containing an IL-15 agent such as $L_0$-X-$L_1$-Y-$L_2$, wherein $L_1$ can be SEQ ID NO: 1169 or SEQ ID NO: 1163, X can be SEQ ID NO: 1176 or SEQ ID NO: 1179, and Y can be SEQ ID NO: 1177, SEQ ID NO: 1178, in any combination. In addition, peptide-IL-15 agent complexes can comprise any of the complexes of TABLE 4.

Example 19

Expression of a 4-1BB Ligand Fused with a Tumor Homing and/or Cell Penetrating Peptide This example describes expression of a 4-1BB ligand fused to any tumor homing and/or cell penetrating peptide of this disclosure, such as any one of SEQ ID NO: 1-SEQ ID NO: 1134, SEQ ID NO: 1243-SEQ ID NO: 1262, or SEQ ID NO: 1263-SEQ ID NO: 1316. The peptide is fused to the N-terminus or the C-terminus of the 4-1BB ligand. Examples of 4-1BB ligands are shown in TABLE 5. The 4-1BB ligand and the peptide are linked via an enzymatically cleavable linker, such as a linker cleaved by cathepsins or MMP. The enzymatically cleavable linker is any one of SEQ ID NO: 1139-SEQ ID NO: 1161, SEQ ID NO: 1360-SEQ ID NO: 1363 and SEQ ID NO: 1365. Alternatively, the 4-1BB ligand and the peptide are linked via a stable linker, such as a linker of any one of SEQ ID NO: 1163-SEQ ID NO: 1168, as shown above in TABLE 10 or other stable linkers. A tag useful for labeling or purification, such as FLAG, is optionally added to the fusion. Said tag can be linked with a linker that is enzymatically cleaved after purification, such as "Xa." A FLAG-Xa linker (DYKDDDD-KIEGR) is shown in SEQ ID NO: 1162.

The peptide can be a peptide of SEQ ID NO: 1, SEQ ID NO: 2, SEQ ID NO: 568, or SEQ ID NO: 569, or any peptide that is 80%, 85%, 90%, 95%, 96%, 97%, 98%, 99% or more identical to any of the foregoing.

The peptide-protein fusion is expressed recombinantly in cells or in a cell-free system using standard molecular biology techniques, such as those described in M. R. Green, Joseph Sambrook. Molecular Cloning. 2012 Cold Spring Harbor Press. For instance, DNA is synthesized that encodes for the designed polypeptide, as well as a leader peptide and other elements necessary for expression. The construct is inserted into an expression vector, which is recombined in a virus used to transfect cells, such as CHO mammalian cells or SF9 insect cells. The protein is expressed and purified. Alternatively, the 4-1BB ligand is chemically conjugated to the tumor homing and/or cell penetrating peptide, using bioconjugate chemistries described in Bioconjugate Techniques by Hermanson.

Example 20

Treatment of a Central Nervous System (CNS) Tumor with a Peptide-RIG-I Ligand Conjugate This example describes treatment of a CNS tumor, including brain tumors, with any peptide of the present disclosure (e.g., any one of SEQ ID NO: 1-SEQ ID NO: 1134, SEQ ID NO: 1243-SEQ ID NO: 1262, or SEQ ID NO: 1263-SEQ ID NO: 1316) conjugated to an I/O disclosed herein. The I/O is a RIG-I ligand. The peptide is recombinantly expressed or chemically synthesized and is conjugated to the RIG-I ligand as described in EXAMPLE 12, EXAMPLE 13, EXAMPLE 15, EXAMPLE 16, or EXAMPLE 17. The peptide-RIG-I ligand conjugate is administered to a subject. The subject is a human or an animal and has a CNS tumor. Administration is intravenous, subcutaneous, intranasal, oral, intraperitoneal, intramuscular, intradermal, or by intratumoral injection. Upon administration, the peptide-RIG-I ligand conjugate is targeted to cancerous tissues and cells thereof. The conjugate is internalized by cancer cells and results in immunogenic cell death, followed by an immune response that reduces or eradicates the cancer, as described in EXAMPLE 38 and exhibits in vivo responses, as described in EXAMPLE 45.

Example 21

Treatment of a Central Nervous System (CNS) Tumor with a Peptide-STING Ligand Conjugate This example describes treatment of CNS tumors, including brain tumors, with any peptide of the present disclosure (e.g., any one of SEQ ID NO: 1-SEQ ID NO: 1134, SEQ ID NO: 1243-SEQ ID NO: 1262, or SEQ ID NO: 1263-SEQ ID NO: 1316) conjugated to an I/O disclosed herein. The I/O is a STING ligand. The peptide is recombinantly expressed or chemically synthesized and is conjugated to the STING ligand as described in EXAMPLE 12, EXAMPLE 13, EXAMPLE 15, EXAMPLE 16, or EXAMPLE 17. The peptide-STING ligand conjugate is administered to a subject. The subject is a human or an animal and has a CNS tumor. Administration is intravenous, subcutaneous, intranasal, oral, intraperitoneal, intramuscular, intradermal, or by intratumoral injection. Upon administration, the peptide-STING ligand conjugate is targeted to cancerous tissues and cells thereof. The conjugate is internalized by cancer cells and results in immunogenic cell death, followed by an immune response that reduces or eradicates the cancer, as described in EXAMPLE 38 and exhibits in vivo responses, as described in EXAMPLE 45.

Example 22

Treatment of Breast Cancer with a Peptide-RIG-I Ligand Conjugate

This example describes treatment of breast cancer with any peptide of the present disclosure (e.g., any one of SEQ ID NO: 1-SEQ ID NO: 1134, SEQ ID NO: 1243-SEQ ID NO: 1262, or SEQ ID NO: 1263-SEQ ID NO: 1316) conjugated to an I/O disclosed herein. The I/O is a RIG-I ligand. The peptide is recombinantly expressed or chemically synthesized and is conjugated to the RIG-I ligand as described in EXAMPLE 12, EXAMPLE 13, EXAMPLE 15, EXAMPLE 16, or EXAMPLE 17. The peptide-RIG-I ligand conjugate is administered to a subject. The subject is a human or an animal and has breast cancer. Administration is intravenous, subcutaneous, intranasal, oral, intraperitoneal, intramuscular, intradermal, or by intratumoral injection. Upon administration, the peptide-RIG-I ligand conjugate is targeted to cancerous tissues and cells thereof. The conjugate is internalized by cancer cells and results in immunogenic cell death, followed by an immune response that reduces or eradicates the cancer, as described in EXAMPLE 38 and exhibits in vivo responses, as described in EXAMPLE 45.

Example 23

Treatment of Breast Cancer with a Peptide-STING Ligand Conjugate

This example describes treatment of breast cancer with any peptide of the present disclosure (e.g., any one of SEQ ID NO: 1-SEQ ID NO: 1134, SEQ ID NO: 1243-SEQ ID NO: 1262, or SEQ ID NO: 1263-SEQ ID NO: 1316) conjugated to an I/O disclosed herein. The I/O is a STING ligand. The peptide is recombinantly expressed or chemically synthesized and is conjugated to the STING ligand as described in EXAMPLE 12, EXAMPLE 13, EXAMPLE 15, EXAMPLE 16, or EXAMPLE 17. The peptide-STING ligand conjugate is administered to a subject. The subject is a human or an animal and has breast cancer. Administration is intravenous, subcutaneous, intranasal, oral, intraperitoneal, intramuscular, intradermal, or by intratumoral injection. Upon administration, the peptide-STING ligand conjugate is targeted to cancerous tissues and cells thereof. The conjugate is internalized by cancer cells and results in immunogenic cell death, followed by an immune response that reduces or eradicates the cancer, as described in EXAMPLE 38 and exhibits in vivo responses, as described in EXAMPLE 45.

Example 24

Treatment of Sarcoma with a Peptide-RIG-I Ligand Conjugate

This example describes treatment of sarcoma with any peptide of the present disclosure (e.g., any one of SEQ ID

Example 25

Treatment of Sarcoma with a Peptide-STING Ligand Conjugate

This example describes treatment of sarcoma with any peptide of the present disclosure (e.g., any one of SEQ ID NO: 1-SEQ ID NO: 1134, SEQ ID NO: 1243-SEQ ID NO: 1262, or SEQ ID NO: 1263-SEQ ID NO: 1316) conjugated to an I/O disclosed herein. The I/O is a RIG-I ligand. The peptide is recombinantly expressed or chemically synthesized and is conjugated to the RIG-I ligand as described in EXAMPLE 12, EXAMPLE 13, EXAMPLE 15, EXAMPLE 16, or EXAMPLE 17. The peptide-RIG-I ligand conjugate is administered to a subject. The subject is a human or an animal and has sarcoma. Administration is intravenous, subcutaneous, intranasal, oral, intraperitoneal, intramuscular, intradermal, or by intratumoral injection. Upon administration, the peptide-RIG-I ligand conjugate is targeted to cancerous tissues and cells thereof. The conjugate is internalized by cancer cells and results in immunogenic cell death, followed by an immune response that reduces or eradicates the cancer, as described in EXAMPLE 38 and exhibits in vivo responses, as described in EXAMPLE 45.

Example 25

Treatment of Sarcoma with a Peptide-STING Ligand Conjugate

This example describes treatment of sarcoma with any peptide of the present disclosure (e.g., any one of SEQ ID NO: 1-SEQ ID NO: 1134, SEQ ID NO: 1243-SEQ ID NO: 1262, or SEQ ID NO: 1263-SEQ ID NO: 1316) conjugated to an I/O disclosed herein. The I/O is a STING ligand. The peptide is recombinantly expressed or chemically synthesized and is conjugated to the STING ligand as described in EXAMPLE 12, EXAMPLE 13, EXAMPLE 15, EXAMPLE 16, or EXAMPLE 17. The peptide-STING ligand conjugate is administered to a subject. The subject is a human or an animal and has sarcoma. Administration is intravenous, subcutaneous, intranasal, oral, intraperitoneal, intramuscular, intradermal, or by intratumoral injection. Upon administration, the peptide-STING ligand conjugate is targeted to cancerous tissues and cells thereof. The conjugate is internalized by cancer cells and results in immunogenic cell death, followed by an immune response that reduces or eradicates the cancer, as described in EXAMPLE 38 and exhibits in vivo responses, as described in EXAMPLE 45.

Example 26

Treatment of Melanoma with a Peptide-RIG-I Ligand Conjugate

This example describes treatment of melanoma with any peptide of the present disclosure (e.g., any one of SEQ ID NO: 1-SEQ ID NO: 1134, SEQ ID NO: 1243-SEQ ID NO: 1262, or SEQ ID NO: 1263-SEQ ID NO: 1316) conjugated to an I/O disclosed herein. The I/O is a RIG-I ligand. The peptide is recombinantly expressed or chemically synthesized and is conjugated to the RIG-I ligand as described in EXAMPLE 12, EXAMPLE 13, EXAMPLE 15, EXAMPLE 16, or EXAMPLE 17. The peptide-RIG-I ligand conjugate is administered to a subject. The subject is a human or an animal and has melanoma. Administration is intravenous, subcutaneous, intranasal, oral, intraperitoneal, intramuscular, intradermal, or by intratumoral injection. Upon administration, the peptide-RIG-I ligand conjugate is targeted to cancerous tissues and cells thereof. The conjugate is internalized by cancer cells and results in immunogenic cell death, followed by an immune response that reduces or eradicates the cancer, as described in EXAMPLE 38 and exhibits in vivo responses, as described in EXAMPLE 45.

Example 27

Treatment of Melanoma with a Peptide-STING Ligand Conjugate

This example describes treatment of melanoma with any peptide of the present disclosure (e.g., any one of SEQ ID NO: 1-SEQ ID NO: 1134, SEQ ID NO: 1243-SEQ ID NO: 1262, or SEQ ID NO: 1263-SEQ ID NO: 1316) conjugated to an I/O disclosed herein. The I/O is a STING ligand. The peptide is recombinantly expressed or chemically synthesized and is conjugated to the STING ligand as described in EXAMPLE 12, EXAMPLE 13, EXAMPLE 15, EXAMPLE 16, or EXAMPLE 17. The peptide-STING ligand conjugate is administered to a subject. The subject is a human or an animal and has melanoma. Administration is intravenous, subcutaneous, intranasal, oral, intraperitoneal, intramuscular, intradermal, or by intratumoral injection. Upon administration, the peptide-STING ligand conjugate is targeted to cancerous tissues and cells thereof. The conjugate is internalized by cancer cells and results in immunogenic cell death, followed by an immune response that reduces or eradicates the cancer, as described in EXAMPLE 38 and exhibits in vivo responses, as described in EXAMPLE 45.

Example 28

Treatment of a CNS Tumor with a Peptide-IL-15 Agent Complex

This example describes treatment of a CNS tumor, including any cancer of the CNS and/or brain, with any peptide of the present disclosure (e.g., any one of SEQ ID NO: 1-SEQ ID NO: 1134, SEQ ID NO: 1243-SEQ ID NO: 1262, or SEQ ID NO: 1263-SEQ ID NO: 1316) expressed as a fusion with an I/O disclosed herein. The I/O is any IL-15 agent disclosed herein. The peptide is recombinantly expressed as a complex with IL-15 as described in EXAMPLE 18. The peptide-IL-15 agent complex is administered to a subject. The subject is a human or an animal and has a brain tumor, including any cancer of the CNS and/or brain. Administration is intravenous, subcutaneous, intranasal, oral, intraperitoneal, intramuscular, intradermal, or by intratumoral injection. Upon administration, the peptide-IL-15 agent complex is concentrated in the tumor microenvironment. Optionally, the IL-15 agent is cleaved from the peptide in the tumor microenvironment or in the tumor cells. Optionally, the IL-15 agent is processed and displayed on the surface of the tumor cells. The IL-15 agent acts on cells of the immune system to initiate, prolong, and/or enhance an immune response that reduces or eradicates the cancer, as described in EXAMPLE 38 and exhibits in vivo responses, as described in EXAMPLE 45.

Other peptide-I/O complexes can similarly be used to treat CNS tumors, such as peptide-IL-15 agent complexes containing an IL-15 agent such as $L_0$-X-$L_1$-Y-$L_2$ wherein $L_1$ can be SEQ ID NO: 1169 or SEQ ID NO: 1163, X can be SEQ ID NO: 1176 or SEQ ID NO: 1179, and Y can be SEQ ID NO: 1177, SEQ ID NO: 1178, in any combination. In addition, peptide-IL-15 agent complexes can comprise any of the complexes of TABLE 4.

Example 29

Treatment of a CNS Tumor with a Peptide-4-1BB Ligand Fusion

This example describes treatment of a brain tumor, including any cancer of the CNS and/or brain, with any peptide of the present disclosure (e.g., any one of SEQ ID NO: 1-SEQ ID NO: 1134, SEQ ID NO: 1243-SEQ ID NO: 1262, or SEQ ID NO: 1263-SEQ ID NO: 1316) expressed as a complex with an I/O disclosed herein. The I/O is a 4-1BB ligand. The peptide is recombinantly expressed as a complex with the 4-1BB ligand as described in EXAMPLE 19. The peptide-4-1BB ligand complex is administered to a subject. The subject is a human or an animal and has a brain tumor, including any cancer of the CNS and/or brain. Administration is intravenous, subcutaneous, intranasal, oral, intraperitoneal, intramuscular, intradermal, or by intratumoral injection. Upon administration, the peptide-4-1BB ligand complex is concentrated in the tumor microenvironment. Optionally, the 4-1BB ligand is cleaved from the peptide in the tumor microenvironment or in the tumor cells. Optionally, the 4-1BB ligand is processed and displayed on the surface of the tumor cells. The 4-1BB ligand acts on cells of the immune system to initiate, prolong, and/or enhance an immune response that reduces or eradicates the cancer, as described in EXAMPLE 38 and exhibits in vivo responses, as described in EXAMPLE 45.

Example 30

Treatment of Breast Cancer with a Peptide-IL-15 Agent Complex

This example describes treatment of breast cancer with any peptide of the present disclosure (e.g., any one of SEQ ID NO: 1-SEQ ID NO: 1134, SEQ ID NO: 1243-SEQ ID NO: 1262, or SEQ ID NO: 1263-SEQ ID NO: 1316) expressed as a fusion with an I/O disclosed herein. The I/O is any IL-15 agent disclosed herein. The peptide is recombinantly expressed as a fusion protein with an IL-15 agent as described in EXAMPLE 18. The peptide-IL-15 agent complex is administered to a subject. The subject is a human or an animal and has breast cancer. Administration is intravenous, subcutaneous, intranasal, oral, intraperitoneal, intramuscular, intradermal, or by intratumoral injection. Upon administration, the peptide-IL-15 agent complex is concentrated in the tumor microenvironment. Optionally, the IL-15 agent is cleaved from the peptide in the tumor microenvironment or in the tumor cells. Optionally, the IL-15 agent is processed and displayed on the surface of the tumor cells. The IL-15 agent acts on cells of the immune system to initiate, prolong, and/or enhance an immune response that reduces or eradicates the cancer, as described in EXAMPLE 38 and exhibits in vivo responses, as described in EXAMPLE 45.

Other peptide-I/O complexes can similarly be used to treat breast cancer, such as peptide-IL-15 agent complexes containing an IL-15 agent such as $L_0$-X-$L_1$-Y-$L_2$ wherein $L_1$ can be SEQ ID NO: 1169 or SEQ ID NO: 1163, X can be SEQ ID NO: 1176 or SEQ ID NO: 1179, and Y can be SEQ ID NO: 1177, SEQ ID NO: 1178, in any combination. In addition, peptide-IL-15 agent complexes can comprise any of the complexes of TABLE 4.

Example 31

Treatment of Breast Cancer with a Peptide-4-1BB Ligand Fusion

This example describes treatment of breast cancer with any peptide of the present disclosure (e.g., any one of SEQ ID NO: 1-SEQ ID NO: 1134, SEQ ID NO: 1243-SEQ ID NO: 1262, or SEQ ID NO: 1263-SEQ ID NO: 1316) expressed as a fusion with an I/O disclosed herein. The I/O is a 4-1BB ligand. The peptide is recombinantly expressed as a fusion protein with the 4-1BB ligand as described in EXAMPLE 19. The peptide-4-1BB ligand fusion is administered to a subject. The subject is a human or an animal and has breast cancer. Administration is intravenous, subcutaneous, intranasal, oral, intraperitoneal, intramuscular, intradermal, or by intratumoral injection. Upon administration, the peptide-4-1BB ligand fusion is concentrated in the tumor microenvironment. Optionally, the 4-1BB ligand is cleaved from the peptide in the tumor microenvironment or in the tumor cells. Optionally, the 4-1BB ligand is processed and displayed on the surface of the tumor cells. The 4-1BB ligand acts on cells of the immune system to initiate, prolong, and/or enhance an immune response that reduces or eradicates the cancer, as described in EXAMPLE 38 and exhibits in vivo responses, as described in EXAMPLE 45.

Example 32

Treatment of Sarcoma with a Peptide-IL-15 Agent Complex

This example describes treatment of sarcoma with any peptide of the present disclosure (e.g., any one of SEQ ID NO: 1-SEQ ID NO: 1134, SEQ ID NO: 1243-SEQ ID NO: 1262, or SEQ ID NO: 1263-SEQ ID NO: 1316) expressed as a fusion with an I/O disclosed herein. The I/O is any IL-15 agent disclosed herein. The peptide is recombinantly expressed as a complex with any IL-15 agent as described in EXAMPLE 18. The peptide-IL-15 agent complex is administered to a subject. The subject is a human or an animal and has sarcoma. Administration is intravenous, subcutaneous, intranasal, oral, intraperitoneal, intramuscular, intradermal, or by intratumoral injection. Upon administration, the peptide-IL-15 agent complex is concentrated in the tumor microenvironment. Optionally, the IL-15 agent is cleaved from the peptide in the tumor microenvironment or in the tumor cells. Optionally, the IL-15 agent is processed and displayed on the surface of the tumor cells. The IL-15 agent acts on cells of the immune system to initiate, prolong, and/or enhance an immune response that reduces or eradicates the cancer, as described in EXAMPLE 38 and exhibits in vivo responses, as described in EXAMPLE 45.

Other peptide-I/O complexes can similarly be used to treat sarcoma, such as peptide-IL-15 agent complexes containing an IL-15 agent such as $L_0$-X-$L_1$-Y-$L_2$ wherein $L_1$ can be SEQ ID NO: 1169 or SEQ ID NO: 1163, X can be SEQ ID NO: 1176 or SEQ ID NO: 1179, and Y can be SEQ ID NO: 1177, SEQ ID NO: 1178, in any combination. In addition, peptide-IL-15 agent complexes can comprise any of the complexes of TABLE 4.

Example 33

Treatment of Sarcoma with a Peptide-4-1BB Ligand Fusion

This example describes treatment of sarcoma with any peptide of the present disclosure (e.g., any one of SEQ ID NO: 1-SEQ ID NO: 1134, SEQ ID NO: 1243-SEQ ID NO: 1262, or SEQ ID NO: 1263-SEQ ID NO: 1316) expressed as a fusion with an I/O disclosed herein. The I/O is a 4-1BB ligand. The peptide is recombinantly expressed as a fusion protein with the 4-1BB ligand as described in EXAMPLE 19. The peptide-4-1BB ligand fusion is administered to a subject. The subject is a human or an animal and has sarcoma. Administration is intravenous, subcutaneous, intranasal, oral, intraperitoneal, intramuscular, intradermal, or by intratumoral injection. Upon administration, the peptide-4-1BB ligand fusion is concentrated in the tumor microenvironment. Optionally, the 4-1BB ligand is cleaved from the peptide in the tumor microenvironment or in the tumor cells. Optionally, the 4-1BB ligand is processed and displayed on the surface of the tumor cells. The 4-1BB ligand acts on cells of the immune system to initiate, prolong, and/or enhance an immune response that reduces or eradicates the cancer, as described in EXAMPLE 38 and exhibits in vivo responses, as described in EXAMPLE 45.

Example 34

Treatment of Melanoma with a Peptide-IL-15 Agent Complex

This example describes treatment of melanoma with any peptide of the present disclosure (e.g., any one of SEQ ID NO: 1-SEQ ID NO: 1134, SEQ ID NO: 1243-SEQ ID NO: 1262, or SEQ ID NO: 1263-SEQ ID NO: 1316) expressed as a fusion with an I/O disclosed herein. The I/O is any IL-15 agent disclosed herein. The peptide is recombinantly expressed as a complex with IL-15 as described in EXAMPLE 18. The peptide-IL-15 agent complex is administered to a subject. The subject is a human or an animal and has melanoma. Administration is intravenous, subcutaneous, intranasal, oral, intraperitoneal, intramuscular, intradermal, or by intratumoral injection. Upon administration, the peptide-IL-15 agent complex is concentrated in the tumor microenvironment. Optionally, the IL-15 agent is cleaved from the peptide in the tumor microenvironment or in the tumor cells. Optionally, the IL-15 agent is processed and displayed on the surface of the tumor cells. The IL-15 agent acts on cells of the immune system to initiate, prolong, and/or enhance an immune response that reduces or eradicates the cancer, as described in EXAMPLE 38 and exhibits in vivo responses, as described in EXAMPLE 45.

Other peptide-I/O complexes can similarly be used to treat melanoma, such as peptide-IL-15 agent complexes containing an IL-15 agent such as $L_0$-X-$L_1$-Y-$L_2$ wherein $L_1$ can be SEQ ID NO: 1169 or SEQ ID NO: 1163, X can be SEQ ID NO: 1176 or SEQ ID NO: 1179, and Y can be SEQ ID NO: 1177, SEQ ID NO: 1178, in any combination. In addition, peptide-IL-15 agent complexes can comprise any of the complexes of TABLE 4.

Example 35

Treatment of Melanoma with a Peptide-4-1BB Ligand Fusion

This example describes treatment of melanoma with any peptide of the present disclosure (e.g., any one of SEQ ID NO: 1-SEQ ID NO: 1134, SEQ ID NO: 1243-SEQ ID NO: 1262, or SEQ ID NO: 1263-SEQ ID NO: 1316) expressed as a fusion with an I/O disclosed herein. The I/O is a 4-1BB ligand. The peptide is recombinantly expressed as a fusion protein with the 4-1BB ligand as described in EXAMPLE 19. The peptide-4-1BB ligand fusion is administered to a subject. The subject is a human or an animal and has melanoma. Administration is intravenous, subcutaneous, intranasal, oral, intraperitoneal, intramuscular, intradermal, or by intratumoral injection. Upon administration, the peptide-4-1BB ligand fusion is concentrated in the tumor microenvironment. Optionally, the 4-1BB ligand is cleaved from the peptide in the tumor microenvironment or in the tumor cells. Optionally, the 4-1BB ligand is processed and displayed on the surface of the tumor cells. The 4-1BB ligand acts on cells of the immune system to initiate, prolong, and/or enhance an immune response that reduces or eradicates the cancer, as described in EXAMPLE 38 and exhibits in vivo responses, as described in EXAMPLE 45.

Example 36

Delivery of RIG-I Ligand to the Cytoplasm of Cancer Cells by Peptide Conjugation This example describes delivery of peptide conjugates with RIG-I ligand to the cytoplasm of cancer cells. RIG-I ligands are conjugated to any peptide of the present disclosure (e.g., SEQ ID NO: 1-SEQ ID NO: 1134, SEQ ID NO: 1243-SEQ ID NO: 1262, or SEQ ID NO: 1263-SEQ ID NO: 1316), as described in EXAMPLE 12, EXAMPLE 13, EXAMPLE 15, EXAMPLE 16, or EXAMPLE 17. The peptide-RIG-I ligand conjugate is administered to a subject, such as a human or a non-human animal. The conjugate accesses the cytoplasm of cancer cells, due to the tumor homing and/or cell penetrating properties of the peptide.

Alternatively, a cancer cell line, such as any human tumor cell line (e.g., MCF-7 human breast cancer cell line, a HepG2 cell line, an Huh7(0.5) cell line, an HT29 cell line, an HCT-15 cell line, a CaCO-2 cell line, an MDA-MB-231 cell line, an MDA-MB-453 cell line, an MDA-MB-468 cell line, a BT-549 cell line, an HCC38 cell line, a 4T1 cell line, an MDA-MB-436 cell line, an HL-60 cell line, a Capan-1 cell line, a CFPAC-1 cell line, an SK-OV3 cell line, a PC3 cell line, a Du145 cell line, a LnCap cell line, an H1299 cell line, an A549 cell line, an H358 cell line, an H460 cell line, an LK2 cell line, a DO4mel cell line, or a Ma-Mel-86c cell line) or any mouse tumor cell line (e.g., a Panc02 cell line, a PANC-1 cell line, a Mia PaCa-2 cell line, a 4T1 cell line, a CT26 cell line, an A20 cell line, an HcMel12 cell line, a B16F10 cell line, an EG7(Ova) cell line, a C1498 cell line, an LLC cell line, a GL261-luc cell line, or an MC38 cell line) is grown in culture. Cells are exposed to the peptide-I/O complex. Upon exposure, the conjugate is internalized by the cells and the I/O is released. The target (RIG-I) is present in the cell cytoplasm and is stimulated by the I/O, resulting in release of Type I Interferon (e.g. IFNβ) into the cell culture medium. The cell culture medium is collected and the amount of Type I Interferon is measured using an ELISA assay. The released amount is compared to the amount of Type I Interferon released from controls, including unstimulated cells and cells treated with free I/O. The I/O, in the absence of peptide conjugation, does not penetrate the cell membrane and is unable to stimulate the target (RIG-I) in the cytoplasm at levels as high as the peptide-I/O complex. An increase in release of Type I Interferon from cultures stimulated with conjugates, compared with controls, demonstrates delivery of the I/O to the cytoplasm by the peptide and stimulation of RIG-I by the RIG-I ligand, which is the I/O.

Example 37

Delivery of STING Ligand to the Cytoplasm of Cancer Cells by Peptide Conjugation This example describes delivery of peptide conjugates with STING ligands to the cytoplasm of cancer cells. STING ligands are conjugated to any peptide of the present disclosure (e.g., SEQ ID NO: 1-SEQ ID NO: 1134, SEQ ID NO: 1243-SEQ ID NO: 1262, or SEQ ID NO: 1263-SEQ ID NO: 1316), as described in EXAMPLE 12, EXAMPLE 13, EXAMPLE 15, EXAMPLE 16, or EXAMPLE 17. The peptide-STING ligand conjugate is administered to a subject, such as a human or a non-human animal. The conjugate access the cytoplasm of cancer cells, due to the tumor homing and/or cell penetrating properties of the peptide.

Alternatively, a cancer cell line, such as any human tumor cell line (e.g., MCF-7 human breast cancer cell line, a HepG2 cell line, an Huh7(0.5) cell line, an HT29 cell line, an HCT-15 cell line, a CaCO-2 cell line, an MDA-MB-231 cell line, an MDA-MB-453 cell line, an MDA-MB-468 cell line, a BT-549 cell line, an HCC38 cell line, a 4T1 cell line, an MDA-MB-436 cell line, an HL-60 cell line, a Capan-1 cell line, a CFPAC-1 cell line, an SK-OV3 cell line, a PC3 cell line, a Du145 cell line, a LnCap cell line, an H1299 cell line, an A549 cell line, an H358 cell line, an H460 cell line, an LK2 cell line, a DO4mel cell line, or a Ma-Mel-86c cell line) or any mouse tumor cell line (e.g., a Panc02 cell line, a PANC-1 cell line, a Mia PaCa-2 cell line, a 4T1 cell line, a CT26 cell line, an A20 cell line, an HcMel12 cell line, a B16F10 cell line, an EG7(Ova) cell line, a C1498 cell line, an LLC cell line, a GL261-luc cell line, or an MC38 cell line) is grown in culture. Cells are exposed to the peptide-I/O complex. Upon exposure, the conjugate is internalized by the cells and the I/O is released or present in the cytoplasm. The target (STING) is present in the cell cytoplasm and is stimulated by the I/O, resulting in release of Type I Interferon (e.g. IFNβ) into the cell culture medium. The cell culture medium is collected and the amount of Type I Interferon is measured using an ELISA assay. The released amount is compared to the amount of Type I Interferon released from controls, including unstimulated cells and cells treated with free I/O. The I/O, in the absence of peptide conjugation, does not penetrate the cell membrane or release from the endosome in sufficient quantities, and is unable to stimulate the target (STING) in the cytoplasm at levels as high as the peptide-I/O complex. An increase in release of Type I Interferon from cultures stimulated with conjugates, compared with controls, demonstrates delivery of the I/O to the cytoplasm by the peptide and stimulation of STING by the STING ligand, which is the I/O.

Example 38

In Vitro Demonstration of Immunogenic Cell Death (ICD)

This example describes induction of immunogenic cell death (ICD) in cancer cells in vitro, following exposure of a peptide-I/O complex of the present disclosure. The peptide (e.g., any one of SEQ ID NO: 1-SEQ ID NO: 1134, SEQ ID NO: 1243-SEQ ID NO: 1262, or SEQ ID NO: 1263-SEQ ID NO: 1316) is recombinantly expressed or chemically synthesized and then conjugated to a RIG-I ligand or a STING ligand as described in EXAMPLE 12, EXAMPLE 13, EXAMPLE 15, EXAMPLE 16, or EXAMPLE 17. A cancer cell line, such as MCF-7 human breast cancer cell line, is grown in culture. Cells are exposed to the peptide-I/O complex. Upon exposure, the peptide-I/O complex is internalized by the cells and the I/O is released or present in the cytoplasm. The I/O stimulates its target (RIG-I, MDA5, or STING), resulting in release of Type I Interferon as described in EXAMPLE 36, as well as other cellular events resulting from ICD. These include secretion of the chemokine CXCL10 and the cytokine IL-6, release of HMGB1 and Hsp70, upregulation of cell surface MHC Class I (MEW I) and Fas expression, and exposure of calreticulin on the cell surface. Cells in culture are exposed to the peptide-I/O complex overnight, for 24 hours, for 48 hours, or longer. Cell culture medium is harvested, and the amount of secreted CXCL10, IL-6, HMGB1, or Hsp70 is measured by ELISA. Expression of MHC I and Fas, as well as the cell surface exposure of calreticulin, is measured by flow cytometry. Induction of cell death is indicated by staining the cells with a monoclonal antibody (mAb) against Annexin V plus propidium iodide (P1) or another fluorescent DNA stain such as 4',6-diamidino-2-phenylindole (DAPI). As cells move through apoptosis, they first express Annexin V and then become permeable to PI. Increases in one or more of these parameters, as compared with control cell cultures, indicates that an ICD pathway has been stimulated by the peptide-I/O complex.

Example 39

In Vitro Demonstration of Dendritic Cell Activation by Cancer Cells Undergoing Immunogenic Cell Death This example describes activation of dendritic cells (DC) following co-culture with cancer cells that are undergoing immunogenic cell death (ICD) following exposure to a any peptide-I/O complex of the disclosure, as described in EXAMPLE 38. CD11c$^+$ dendritic cells are isolated from mouse spleens and grown in culture with, for example, any human tumor cell line (e.g., MCF-7 human breast cancer cell line, a HepG2 cell line, an Huh7(0.5) cell line, an HT29 cell line, an HCT-15 cell line, a CaCO-2 cell line, an MDA-MB-231 cell line, an MDA-MB-453 cell line, an MDA-MB-468 cell line, a BT-549 cell line, an HCC38 cell line, a 4T1 cell line, an MDA-MB-436 cell line, an HL-60 cell line, a Capan-1 cell line, a CFPAC-1 cell line, an SK-OV3 cell line, a PC3 cell line, a Du145 cell line, a LnCap cell line, an H1299 cell line, an A549 cell line, an H358 cell line, an H460 cell line, an LK2 cell line, a DO4mel cell line, or a Ma-Mel-86c cell line) or any mouse tumor cell line (e.g., a Panc02 cell line, a PANC-1 cell line, a Mia PaCa-2 cell line, a 4T1 cell line, a CT26 cell line, an A20 cell line, an HcMel12 cell line, a B16F10 cell line, an EG7(Ova) cell line, a C1498 cell line, an LLC cell line, a GL261-luc cell line, or an MC38 cell line) that have been treated with a peptide-I/O complex of the present disclosure. Untreated MCF-7 cells are used as a negative control. Cells are co-cultured for up to 12 hours, overnight, for 24 hours, for 48 hours, or longer. Following co-culture, expression of cell surface markers on the DCs and cytokine production into the medium of the co-cultures are measured. Cell surface markers that are upregulated on DCs include costimulatory molecules CD80 and CD86 and the early activation marker CD69. Levels of the cytokines IL-1, IL-6, and/or CXCL10 are significantly higher in medium from co-cultures than from cultures of stimulated tumor cells alone, which indicates production predominantly from DCs.

Example 40

Liposomal Delivery

This example describes use of a liposome to deliver a drug or a peptide-drug conjugate of the present disclosure to cancer cells in vivo. A peptide of the present disclosure is attached to the surface of a liposomal particle or other nanoparticle as described in EXAMPLE 41. A RIG-I or STING ligand of the present disclosure is encapsulated in the liposome. The liposome is delivered to a patient intravenously or by intratumoral injection. The peptide targets the liposome for internalization by tumor cells. Following internalization, the ligand is delivered to the cytoplasm of the tumor cells, where it can stimulate its target and induce immunogenic cell death (ICD).

Example 41

Liposome Manufacturing

This example describes liposome manufacturing. Soybean phosphatidylcholine, DC-chol, DSPE-PEG, and Maleimide-PEG2000-DSPE are dissolved in chloroform. The solvent is evaporated by rotary evaporation or blowing gas. The lipid film is redissolved in chloroform and the I/O to be delivered (e.g., a RIG-I ligand, a STING ligand, an IL-15 agent, a 4-1BB ligand, or an MDA5 ligand) is added in buffer. The mixture is vortexed and sonicated. The solution is evaporated at 37° C. to remove chloroform and leave the liposomes in an aqueous phase solution. The solution is extruded by turning through a polycarbonate filter (e.g., 400 nm, 200 nm, and then 100 nm). A peptide of this disclosure comprises a thiol group, which is introduced on the peptide by reacting an amine group with Traut's reagent. The thiolated peptide is incubated with extruded liposomes and the thiol group of the peptide reacts with the maleimide group of a lipid, thus obtaining a liposome displaying on its surface, a peptide of this disclosure. Optionally, the agent to deliver is instead, or also, functionalized with a thiol group and incubated with the liposomes, thus obtaining a liposome that is decorated with the agent on its surface. After incubation overnight at room temperature, liposomes are purified by chromatography.

Example 42

In Vitro Bioactivity of Peptide-IL-15 Agent Complexes or Peptide-IL-15 Hyperagonist Complexes This example describes the in vitro bioactivity of any IL-15 agent or, specifically, an IL-15 hyperagonists (I/Os) expressed as complexes with any peptide of this disclosure (e.g., any one of SEQ ID NO: 1-SEQ ID NO: 1134, SEQ ID NO: 1243-SEQ ID NO: 1262, or SEQ ID NO: 1263-SEQ ID NO: 1316). A peptide of the present disclosure is recombinantly expressed as a complex with an IL-15 agent or an IL-15 hyperagonist (e.g., any one of SEQ ID NO: 1135-SEQ ID NO: 1138) as described in EXAMPLE 18. Human peripheral blood mononuclear cells (PBMC) are isolated from healthy adult donors and prepared by density gradient centrifugation. Cells are cultured in medium with no added cytokine (negative control), with recombinant human IL-15 (positive control), or with an equimolar quantity of the peptide-I/O complex described herein. After culture for up to 7 days, cells are stained with antibodies to cell surface proteins specific to the various cell lineages and quantitated using flow cytometry. Expansion of CD56+ T cell and NK cell populations relative to negative control cultures indicates that IL-15 activity is present.

The cytotoxicity of T cells is also increased by the IL-15 agent or the IL-15 hyperagonist. To measure this activity, CD3+ T cells are isolated from PBMCs using antibody-coated magnetic beads and isolated cells are cultured in medium with no added cytokine (negative control), with recombinant human IL-15 (positive control), or with an equimolar quantity of the peptide-I/O fusion described herein. After culture for up to 7 days, cells are used as effectors in a cytotoxicity assay against a target cell line such as K562 (human leukemia cell line). Target cell killing is measured, for example, by a 51Cr release assay. An increase in cytotoxic effector function indicates that IL-15 activity is present.

IL-15 activity is quantified in vitro by its ability to stimulate proliferation of factor dependent cell lines, including CTLL, 32D, and TF1. Proliferation of activated human peripheral blood T cells can also be used to measure IL-15 activity. For example, different IL-15 fusions are added, at various concentrations, to cultures of factor dependent cell lines or T cells. After several days of culture (1-4 days), the number of cells in each culture can be measured by any one of a number of quantitative methods to detect live cells. The concentration of the cytokine fusion that gives 50% of maximal proliferation is used as a measure of the potency.

Other peptide-I/O complexes can similarly exhibit that IL-15 activity, such as peptide-I/O complexes, which are fusions of IL-15 with IL-15Ra sushi+ and any peptide of the present disclosure (e.g., any one of SEQ ID NO: 1-SEQ ID NO: 1134, SEQ ID NO: 1243-SEQ ID NO: 1262, or SEQ ID NO: 1263-SEQ ID NO: 1316), and peptide-IL-15 agent complexes containing an IL-15 agent such as $L_0$-X-$L_1$-Y-$L_2$, wherein $L_1$ can be SEQ ID NO: 1169 or SEQ ID NO: 1163, X can be SEQ ID NO: 1176 or SEQ ID NO: 1179, and Y can be SEQ ID NO: 1177, SEQ ID NO: 1178, in any combination. In addition, peptide-IL-15 agent complexes can comprise any of the complexes of TABLE 4.

Example 43

Fusions of IL-15 with IL-15Ra Sushi+ and Peptides

Figure 3A:
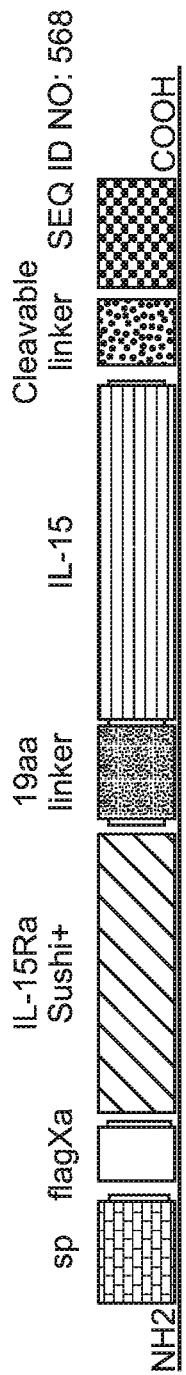
FIG. 3A illustrates a cartoon of an exemplary RLIX peptide-I/O complex from the N to C-terminus direction with an exemplary IL-15Ra, linker, IL-15, and chlorotoxin or chlorotoxin derivative peptide.

This example describes peptide-I/O complexes, which are fusions of IL-15 with IL-15Ra sushi+ and any peptide of the present disclosure (e.g., any one of SEQ ID NO: 1-SEQ ID NO: 1134, SEQ ID NO: 1243-SEQ ID NO: 1262, or SEQ ID NO: 1263-SEQ ID NO: 1316) for the purpose of delivering a hyper potent IL-15 agent to tumors. The fusions are comprised of IL-15 and portions of IL-15Ra, which are further linked to a peptide of the present disclosure via linkers, including a linker that is, optionally, cleavable between the IL-15-IL15Ra hyperagonist fusion and the peptide of the present disclosure for intracellular release of the IL-15 hyperagonist fusion allowing for recycling back to the cell surface or secretion. FIG. 3A shows an illustration of an IL-15 hyperagonist fusion with a peptide of this disclosure SEQ ID NO: 568 (adapted from Mortier et al. (J Biol Chem. 2006 Jan. 20; 281(3):1612-9)), which is used as an example and can be substituted with any peptide of the present disclosure.

Figure 3B:
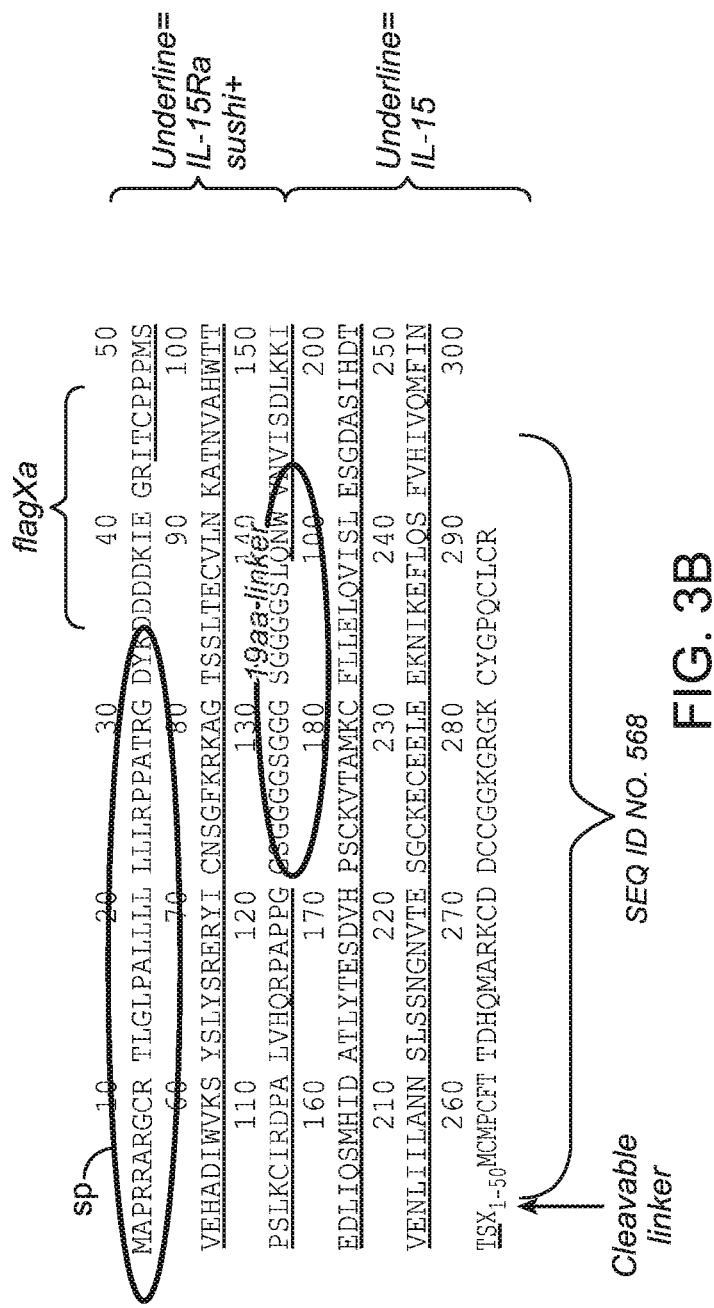
FIG. 3B illustrates the sequence of an exemplary RLIX peptide-I/O complex of FIG. 3A.

FIG. 3A illustrates the sequence of IL-15Ra using the sushi+ portion, a linker, IL-15, and SEQ ID NO: 568 (referred to as an "RLIX" from the N to C-terminus direction). The sequence of said fusion is set forth in SEQ ID NO: 1173 (MAPRRARGCRTLGLPALLLLLLLRPPATRG-DYKDDDDKIEGRITCPPPMSVEHADIWVK SYSLYSR-ERYICNSGFKRKAGTSSLTECVLNKATNVAHWTT-PSLKCIRDPALVHQRPAPP GGSGGGGSGGGSGG-GGSLQNWVNVISDLKKIEDLIQSMHIDATLYTESD-VHPSCKVTA MKCFLLELQVISLESGDASIHDTVEN-LIILANNSLSSNGNVTESGCKECEELEEKNIKEFL QSFVHIVQMFINTSXXXXXXXXXXXXXXXXXXXX-XXXXXXXXXXXXXXXXXXXX XXXXXXXX-XMCMPCFTTDHQMARKCDDCCGGKGRGKCY-GPQCLCR also shown in FIG. 3B). The Xs in SEQ ID NO: 1173 is replaced by a linker. The linker can be cleavable (e.g., any one of SEQ ID NO: 1139-SEQ ID NO: 1161, SEQ ID NO: 1360-SEQ ID NO: 1363 and SEQ ID NO: 1365) or can be stable (e.g., any one of SEQ ID NO: 1163-SEQ ID NO: 1172). The Sp leader (MAPRRARGCR TLGLPALLLL LLLRPPATRG) (SEQ ID NO: 1232) and FLAG-Xa tag are both optional, as directions for secretion and a tag for labeling, which can be replaced with other leaders or tags or omitted. FIG. 4A shows an illustration of IL-15, a linker, IL-15Ra sushi+, and a peptide of SEQ ID NO: 568 (referred to as an "ILRX"), and whose sequence is set forth in SEQ ID NO: 1174 (MAPRRARGCRTLGLPALLLLLLLRP-PATRGDYKDDDDKIEGRNWVNVISDLKKIEDLIQ SMHIDATLYTESDVHPSCKVTAMKCFLLELQVISL-ESGDASIHDTVENLIILANNSLSSNG NVTESGCKE-CEELEEKNIKEFLQSFVHIVQMFINTSSGGGSGG-GGSGGGGSGGGGSGGG SLQITCPPPMSVEHAD-IWVKSYSLYSRERYICNSGFKRKAGTSSLTECV-LNKATNVAHW TTPSLKCIRDPALVHQRPAPPXXXX-XXXXXXXXXXXXXXXXXXXXXXXXXXXXXX XXXXXXXXXXXXXXXMCMPCFTTDHQMARKC-DDCCGGKGRGKCYGPQCLCR; also shown in FIG. 4B). The Sp leader (SEQ ID NO: 1232) and Flag-Xa tag are both optional, as directions for secretion and a tag for labeling, which can be replaced with other leaders or tags or omitted. The full sequence includes the mature secreted protein and the IL-15Rα sushi+ sequence (comprising the sushi domain encoded by Exon 2 plus the N terminal 13 amino acids encoded by Exon 3). For example, the IL-15 agent can be $L_0$-X-$L_1$-Y-$L_2$, wherein one of X or Y can be any one SEQ ID NO: 1177 or SEQ ID NO: 1178 and one of X or Y can be SEQ ID NO: 1176. Furthermore, $L_0$, $L_1$ and $L_2$ can be any one of SEQ ID NO: 1163-SEQ ID NO: 1172 or can be Xn, where each X is independently any amino acid and n=1-50 or can be absent. As another example, the IL-15 agent can be $L_0$-X-$L_1$-Y-$L_2$, wherein $L_1$ can be SEQ ID NO: 1169 or SEQ ID NO: 1163, X can be SEQ ID NO: 1176 or SEQ ID NO: 1179, and Y can be SEQ ID NO: 1177, SEQ ID NO: 1178, in any combination. In addition, peptide-IL-15 agent complexes can comprise any of the complexes of TABLE 4.

SEQ ID NO: 1162, encoding for the FLAG epitope and Factor Xa binding site (FLAG-Xa) is optionally added between the signal peptide (which directs its post-translational secretion) and the coding sequences. A signal peptide is a native sequence associated with a subunit, or an artificial one. A linker peptide, such as the 19aa peptide NH2-GGSGGGGSGGGSGGGGSLQ-COOH (SEQ ID NO: 1163) (Bouchard et al. J Mol Biol. 2008 Sep. 26; 382(1):1-12), or the 20aa peptide NH2-SGGGGSGGGSGGGSGGGGSLQ-NH2 (SEQ ID NO: 1169) (Mortier et al. J Biol Chem. 2006 Jan. 20; 281(3):1612-9) is inserted in an RLIX between the C-terminus of IL-15Rα-sushi+ and the N-terminus of IL-15. The 26aa linker peptide: NH2-SGGGSGGGGSGGGGSGGGGSGGGSLQ-COOH (SEQ ID NO: 1165) (Mortier 2006) is inserted in ILRX between the N-terminus of IL-15Rα-sushi+ and the C-terminus of IL-15. The cleavable linker (NH2-cleavable linker) is inserted between the C terminus of IL-15 (RLIX), or 15Rα-sushi+(ILRX), and the N-terminus of chlorotoxin. The NH2-cleavable linker can be any cleavable linker, such as any one of SEQ ID NO: 1139-SEQ ID NO: 1161, SEQ ID NO: 1360-SEQ ID NO: 1363 and SEQ ID NO: 1365.

In addition to the IL-15 sequence described above, one or more of the following IL-15 mutants can be substituted: L45D (Bernard et al. J Biol Chem. 2004 Jun. 4; 279(23): 24313-22), L45E (Bernard et al. J Biol Chem. 2004 Jun. 4; 279(23):24313-22), Q48K (Bernard et al. J Biol Chem. 2004 Jun. 4; 279(23):24313-22), V49D (Bernard et al. J Biol Chem. 2004 Jun. 4; 279(23):24313-22), S51D (Bernard et al. J Biol Chem. 2004 Jun. 4; 279(23):24313-22), L52D (Bernard et al. J Biol Chem. 2004 Jun. 4; 279(23):24313-22), N72D (Zhu 2009 and U.S. Ser. No. 00/816,3879), N72E (Zhu 2009), N72A (Zhu 2009), N72S (Zhu 2009), N72Y (Zhu 2009), N72R (U.S. Ser. No. 00/816,3879), or D61A (U.S. Ser. No. 00/816,3879) where the first letter denotes the amino acid that is mutated as the position in the IL15 sequence denoted by the number and the second letter denotes the new amino acid that is substituted. For example, L45D means the L at position 45 in IL15 is mutated to D. The endogenous 30aa IL-15Rα signal peptide can be substituted with any of the signal peptides that are used in the art for efficient CHO secretion.

Peptides disclosed herein were conjugated (e.g., recombinantly fused) to various IL-15 agents to obtain peptide-IL-15 agent complexes. Peptides of the present disclosure were fused via a linker to the full length, mature human IL-15 (SEQ ID NO: 1177) and residues 1-77 of the IL-15Rα sushi domain of the human IL-15 receptor (SEQ ID NO: 1176). Peptide-IL-15 agent complexes included rigid and flexible linkers (Chen 2013) and comprised peptides of SEQ ID NO: 568 and SEQ ID NO: 569, or any peptide that is 80%, 85%, 90%, 95%, 96%, 97%, 98%, 99% or more identical to any of the foregoing. Some peptide-IL-15 agent complexes also included a designed enzymatic cleavage site, such as a cathepsins cleavable Val-Ala site (SEQ ID NO: 1139) (Kramer 2017, Jain 2015) or an MMP cleavable PLGLAG sequence (SEQ ID NO: 1499) (Aguilera 2009). A 10x His tag (SEQ ID NO: 1498) or a FLAG tag was added, usually to the end of the peptide-I/O complex not bearing the peptide, to facilitate purification and labeling. Sequences of peptide-IL-15 agent complexes are shown in TABLE 4. The genes for peptide-I/O complexes having sequences of SEQ ID NO: 1317-SEQ ID NO: 1329 were synthesized.

Molecular biology was performed. Gene sequences were generated using the following design: HindIII-Kozak-ig-kappa-10xHis (SEQ ID NO: 1498)-GOI-**-EcoRI, where the IgK leader was METDTLLLWVLLLWVPGST (SEQ ID NO: 1500) and GOI means gene of interest. The gene was synthesized and directly subcloned into expression vector pcDNA3.4 and the sequence of the coding region was verified. 5 μg of purified plasmid DNA containing the synthesized gene of interest was cloned into the mammalian expression vector was supplied. The genes were successfully synthesized and plasmids were generated.

Expression and RLI Purification.

Peptide-I/O complexes of SEQ ID NO: 1317-SEQ ID NO: 1321 were expressed at 100 mL scale in Expi293 (HEK293) cell culture at 37° C. with 8% $CO_2$ and a rotational speed of 125 RPM. Conditioned supernatant was harvested as soon as viability dropped below 80% (6 days post-transfection) and isolated by centrifugation. The resulting conditioned media was frozen on dry ice.

An RLI (containing an IL-15 agent such as $L_0$-X-$L_1$-Y-$L_2$, wherein $L_1$ can be SEQ ID NO: 1169 or SEQ ID NO: 1163, X can be SEQ ID NO: 1176 or SEQ ID NO: 1179, and Y can be SEQ ID NO: 1177, SEQ ID NO: 1178, in any combination as a His-tagged RLI protein (SEQ ID NO: 1342) was similarly expressed at 300 mL scale at a rotational speed of 85 RPM and purified using a HisTrap IMAC column. Elution was performed using a linear gradient from 20-500 mM imidazole in PBS, 500 mM NaCl. Fractions D13-H13 were pooled, followed by 16 h dialysis against PBS. 63 mg of product at 0.67 mg/mL (based on A280 and $E^{1\%}$ of 9.3) was frozen as 47×2.0 mL aliquots and shipped. Analysis included reducing SDS-PAGE with Coomassie staining and a reducing Western blot using an anti-His antibody, with 12 µL loaded per lane.

Purification of SEQ ID NO: 1317-SEQ ID NO: 1321.

A small-scale purification of SEQ ID NO: 1317-SEQ ID NO: 1321 was performed using HisPur NI-NTA nickel columns. For each peptide-IL-15 agent complex, 2 mL of conditioned supernatant was mixed with 2 mL of equilibration buffer (20 mM sodium phosphate, 300 mM sodium chloride (PBS) with 10 mM imidazole; pH 7.4) The columns were equilibrated with 2 mL equilibration buffer prior to initial loading and 4 mL of 1:1 diluted sample was loaded onto the column and allowed to flow through. The flow-through (FT) fraction was collected and stored at 4° C. Following loading the column was washed 3 times with 2 mL each of wash buffer (PBS with 25 mM imidazole; pH 7.4) and each fraction (W1-3) was collected separately (3×2 mL) and stored at 4° C. The peptide-IL-15 agent complexes were eluted by adding 1 mL of elution buffer (PBS with 250 mM imidazole) and repeating two more times, collecting a total of 3 mL (3×1 mL). Eluted fractions (E1-3) were stored at 4° C. All fractions (Sup, FT, W1-3, and E1-3) were analyzed by reducing SDS-PAGE (20 µL load per lane) and stained with Coomassie Blue (Simply Blue Coomassie Stain).

Eluted fractions containing the fusion proteins were pooled (2 mL total) and buffer exchanged with PBS using Zeba spin desalting columns (5 mL bed volume). Columns were prepared by placing columns in a 15 mL conical collection tube and centrifuged at 1000×g for 2 minutes to remove storage buffer. PBS (2.5 mL) was added to the column and centrifuged 1000×g for 2 minutes and repeated three additional times discarding buffer from the collection tube each time. The column was placed in a new collection tube and 2 mL of sample was applied to the center of the resin bed. The column was centrifuged at 1000×g for 2 minutes to collect the sample. All samples were analyzed by reducing SDS-PAGE and stained with Coomassie Blue and quantitated based on A280 and $E^{1\%}$ (range between 8.2-8.6). Samples were aliquoted (500 µL each) into Eppendorf tubes and stored at −20° C.

A large-scale purification (10×) was performed on each peptide-IL-15 agent complex of SEQ ID NO: 1317 and SEQ ID NO: 1321 by mixing 20 mL of each supernatant with 20 mL of equilibration buffer. The 1:1 diluted sample (40 mL) was loaded onto the nickel column and washed and eluted using the same conditions described above for the small-scale purification but adding additional washing (5×2 mL) and elution (5×1 mL) steps. All fractions were analyzed by reducing SDS-PAGE and stained with Coomassie Blue. Following buffer exchange in PBS of pooled eluted fractions the final samples were compared by both reducing and non-reducing SDS-PAGE.

Figure 45:
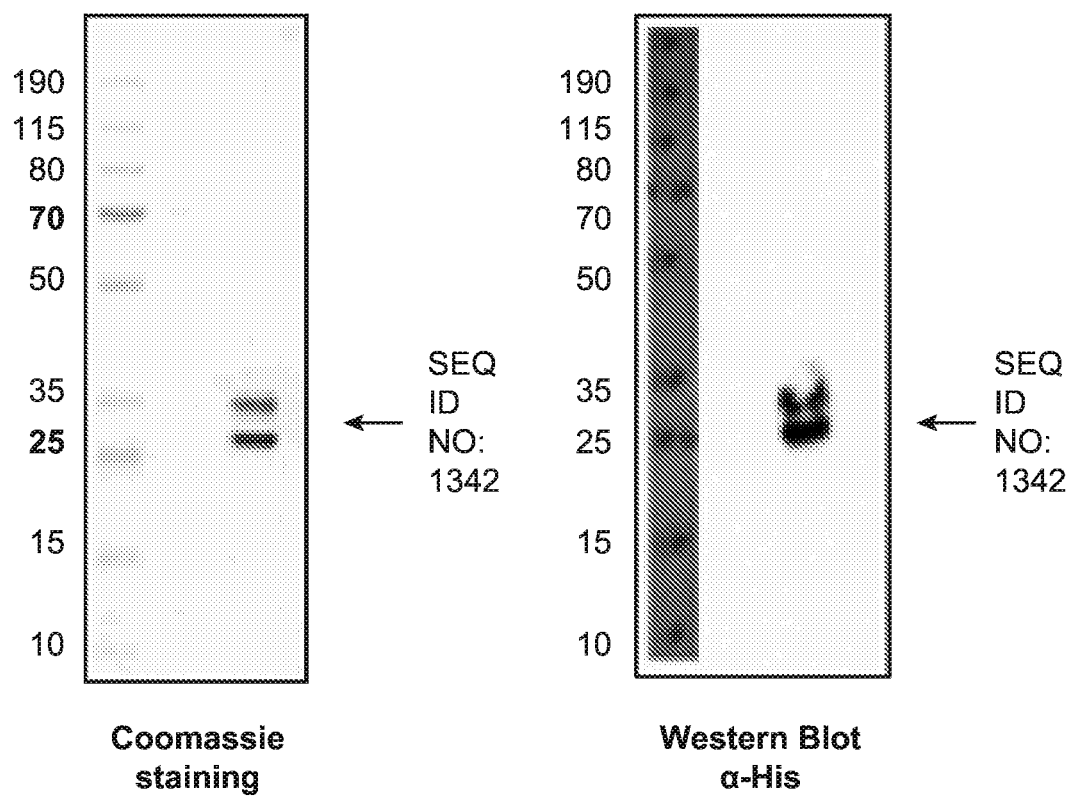
FIG. 45 illustrates coomassie-stained SDS-PAGE and anti-His Western analysis of an RLI protein (such as containing SEQ ID NO: 1169, SEQ ID NO: 1176, and SEQ ID NO: 1177) as a His-tagged RLI protein (SEQ ID NO: 1342) and shows strong signal of two bands, around 25-26 and 30-34 kDa.

Expression of exemplary RLI protein (e.g., containing an IL-15 agent such as $L_0$-X-$L_1$-Y-$L_2$, wherein $L_1$ can be SEQ ID NO: 1169 or SEQ ID NO: 1163, X can be SEQ ID NO: 1176 or SEQ ID NO: 1179, and Y can be SEQ ID NO: 1177, SEQ ID NO: 1178, in any combination as a His-tagged RLI protein (SEQ ID NO: 1342) purification. The 300 mL SEQ ID NO: 1342 expression and purification yielded 63 mg of product at 0.67 mg/mL (28 or 0.2 mg per mL of cell culture. FIG. 45 illustrates coomassie-stained SDS-PAGE and anti-His Western analysis of an RLI protein (such as containing SEQ ID NO: 1169, SEQ ID NO: 1176, and SEQ ID NO: 1177) as a His-tagged RLI protein (SEQ ID NO: 1342) and shows strong signal of two bands, around 25-26 and 30-34 kDa The two bands may represent different glycosylation patterns, as was seen in Kermer et al. (Mol Cancer Ther. 2012 June; 11(6):1279-1288).

Figure 46:
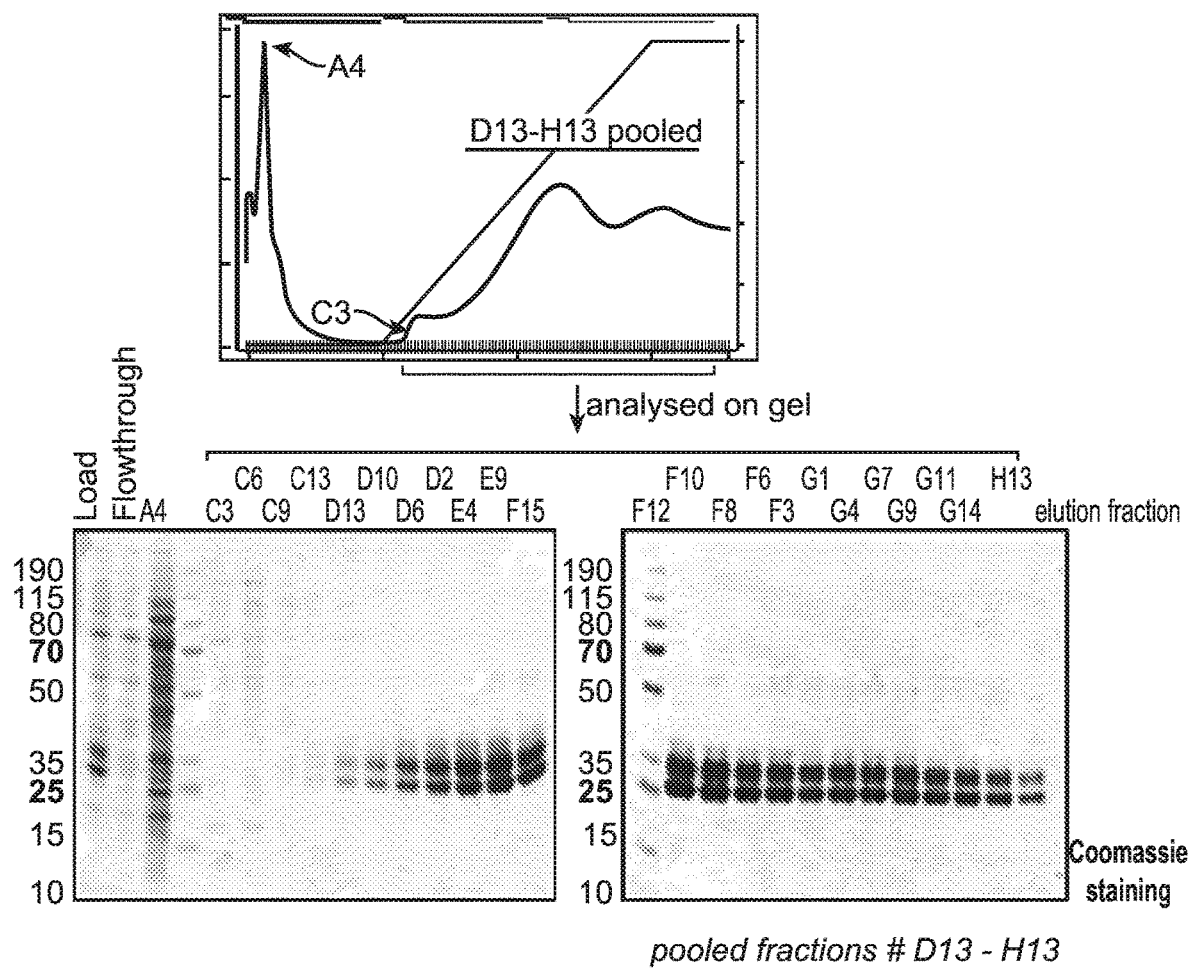
FIG. 46 illustrates the chromatogram and SDS-PAGE analysis of IMAC purification of an RLI protein as a His-tagged RLI protein (SEQ ID NO: 1342).
Figure 47:
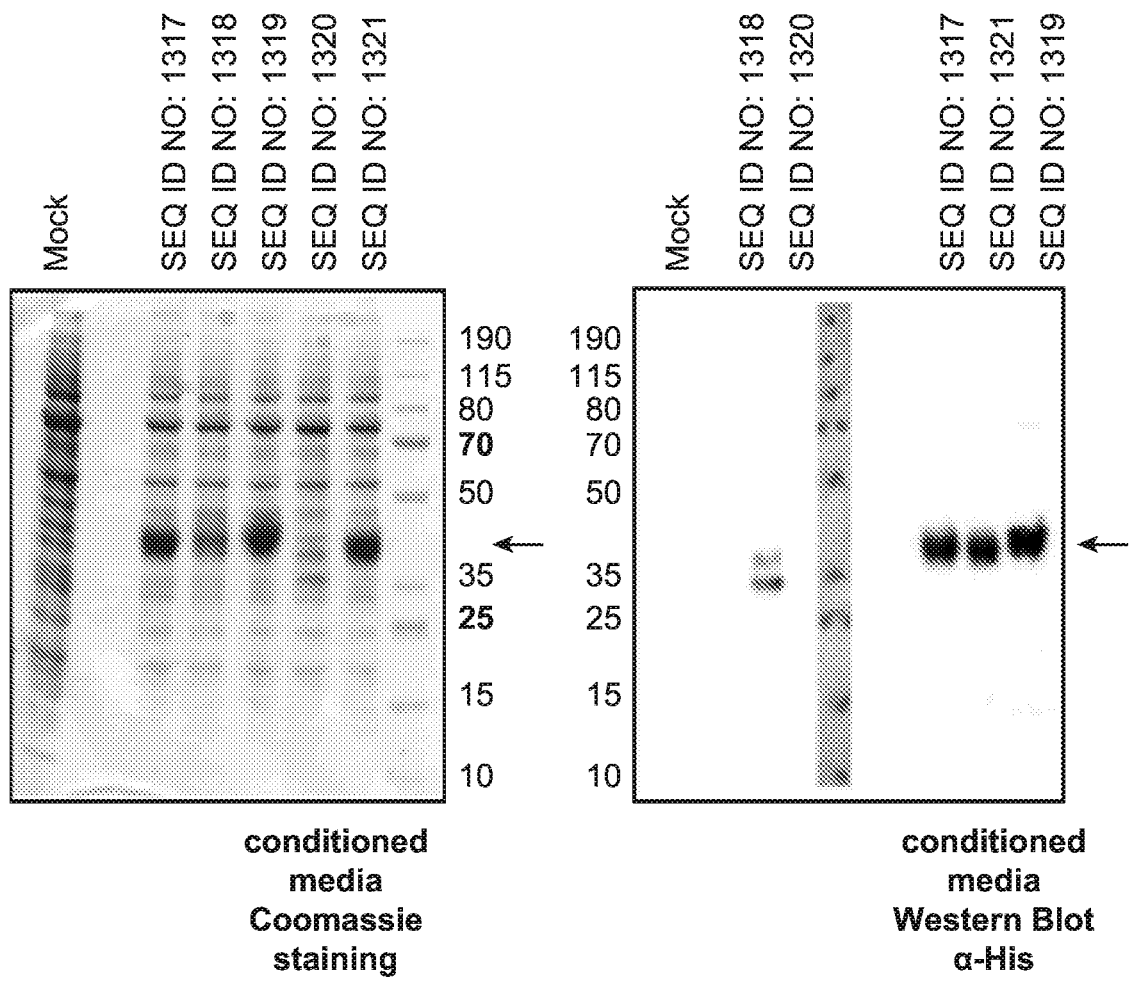
FIG. 47 illustrates coomassie-stained SDS-PAGE and anti-His Western analysis of the conditioned media from expression of SEQ ID NO: 1317-SEQ ID NO: 1321.

FIG. 46 illustrates the chromatogram and SDS-PAGE analysis of IMAC purification of RLI protein (comprising SEQ ID NO: 1169, SEQ ID No 1176, and SEQ ID No 1177) as a His-tagged RLI protein (SEQ ID NO: 1342). Fractions D13-H13 were pooled and dialyzed to yield the final material. FIG. 47 illustrates coomassie-stained SDS-PAGE and anti-His Western analysis of the conditioned media from expression of SEQ ID NO: 1317-SEQ ID NO: 1321. SEQ ID NO: 1317, SEQ ID NO: 1319, and SEQ ID NO: 1321 exhibited a strong band around 38-42 kDa by both analyses. The width and fuzziness of the band could indicate multiple overlapping glycosylation patterns. At the N-terminus, SEQ ID NO: 1317, SEQ ID NO: 1319, and SEQ ID NO: 1321 all have a His tag followed by the IL-15Rα protein. SEQ ID NO: 1318 had a much fainter band near the target size by Coomassie stain but no signal evident in this Western analysis. SEQ ID NO: 1318 also had an N-terminal His tag, but the His tag is adjacent to IL-15. It is possible this conformation makes the His tag less available to the anti-His antibody for Western visualization. SEQ ID NO: 1320 exhibited little if any staining visible at the target size by Coomassie, though it did exhibit signal (2 bands around 34 and 39 kDa, which may also represent different glycosylation patterns) by Western analysis. SEQ ID NO: 1320 comprises at its N-terminus, a peptide of SEQ ID NO: 568, and has the His tag at its C-terminus. Higher expression yields seem to be obtained with an 15Rα-sushi+ at the N-terminus than with the IL-15 or SEQ ID NO: 568 at the N-terminus.

Purification of SEQ ID NO: 1317 and SE ID NO: 1321.

Figure 48:
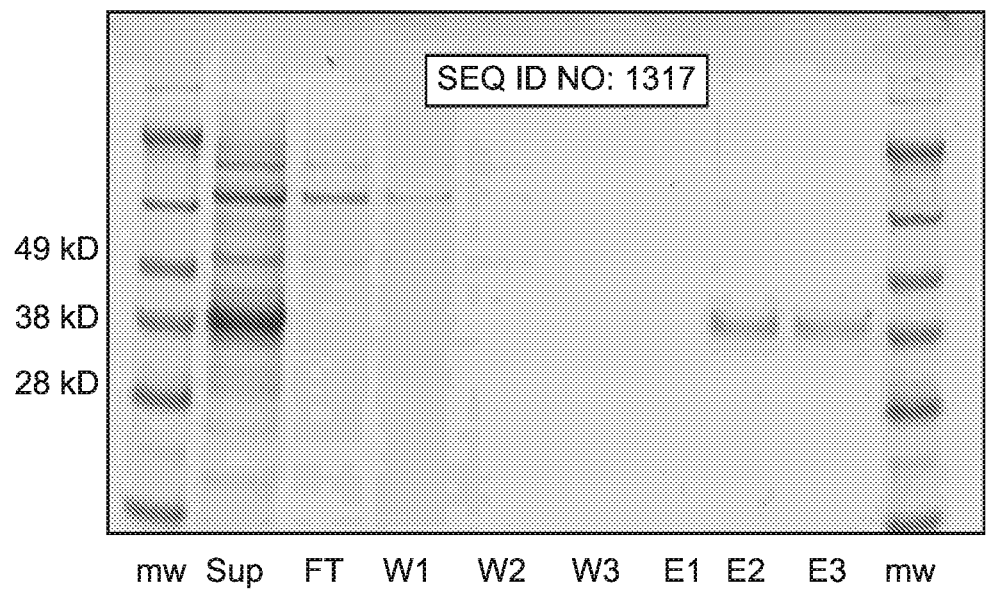
FIG. 48 illustrates Coomassie-stained SDS-PAGE of fractions obtained from the small-scale purification of peptide-IL-15 agent complexes of SEQ ID NO: 1317 and SEQ ID NO: 1321.
Figure 48:
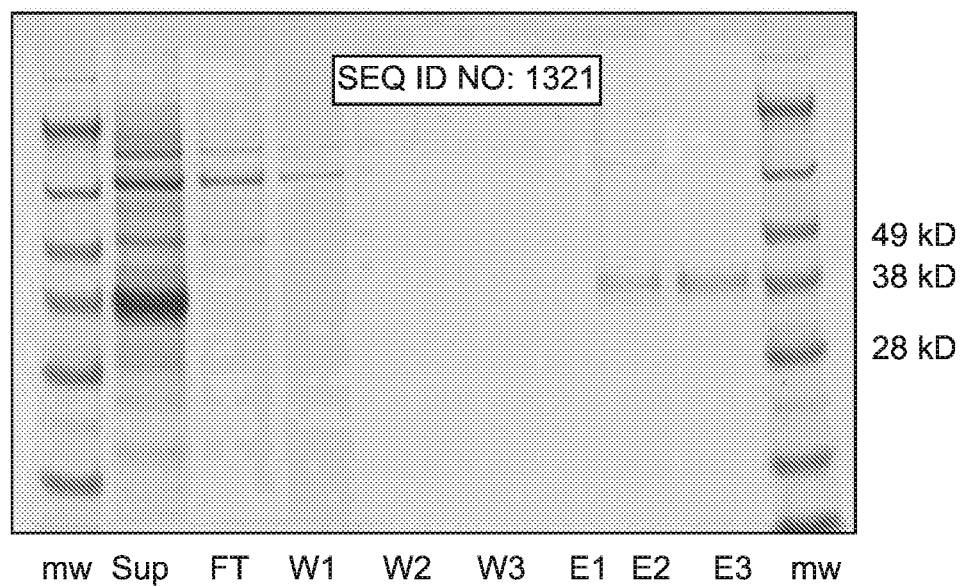
Figure 49:
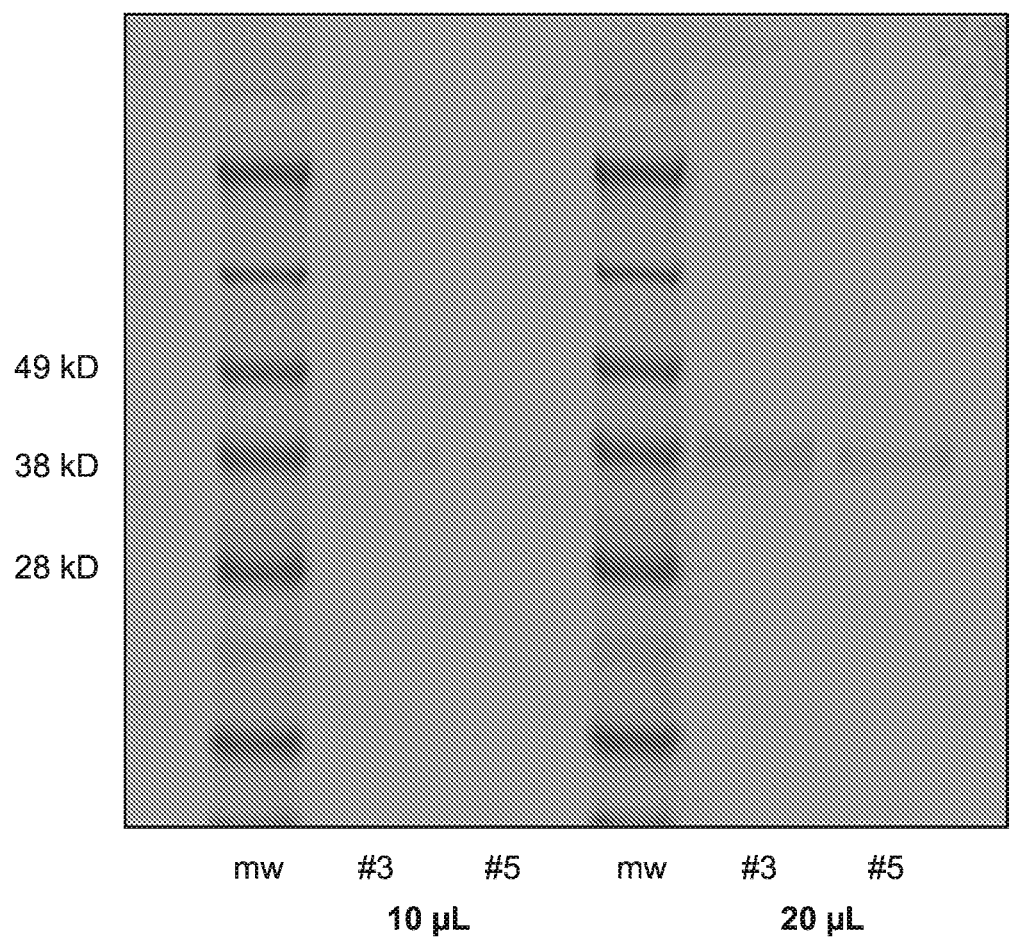
FIG. 49 illustrates Coomassie-stained SDS-PAGE of purified fractions E2-E3 for each peptide-IL-15 agent complexes SEQ ID NO: 1317 (#3) and SEQ ID NO: 1321 (#5) after pooling and buffer exchange in PBS.

FIG. 48 illustrates Coomassie-stained SDS-PAGE of fractions obtained from the small-scale purification of peptide-IL-15 agent complexes of SEQ ID NO: 1317 and SEQ ID NO: 1321. FIG. 49 illustrates Coomassie-stained SDS-PAGE of purified fractions E2-E3 for each peptide-IL-15 agent complex after pooling and buffer exchange in PBS. Both SEQ ID NO: 1317 and SEQ ID NO: 1321 bound and eluted from the nickel column as predicted and the purified forms of each fusion revealed a band at approximately 38 kD by SDS-PAGE, which was found to be consistent with the Western Blot data describe above.

Purification of SEQ ID NO: 1318.

Figure 50:
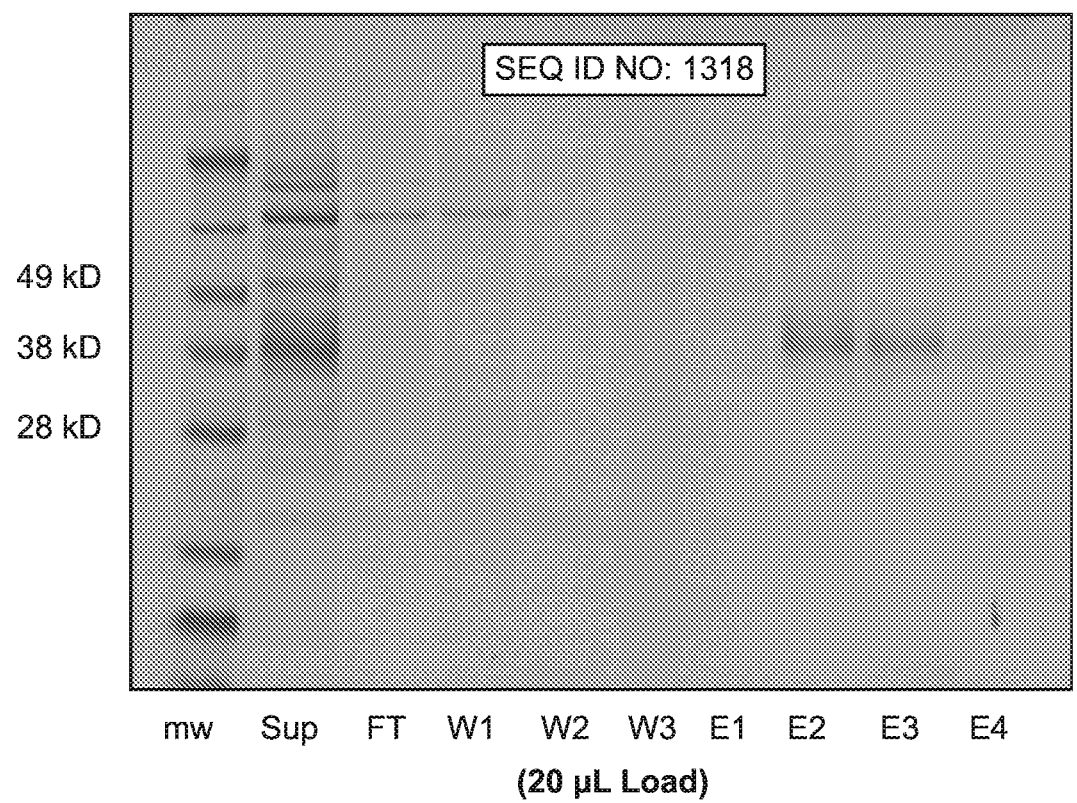
FIG. 50 illustrates Coomassie-stained SDS-PAGE of fractions obtained from the small-scale purification of SEQ ID NO: 1318.
Figure 51:
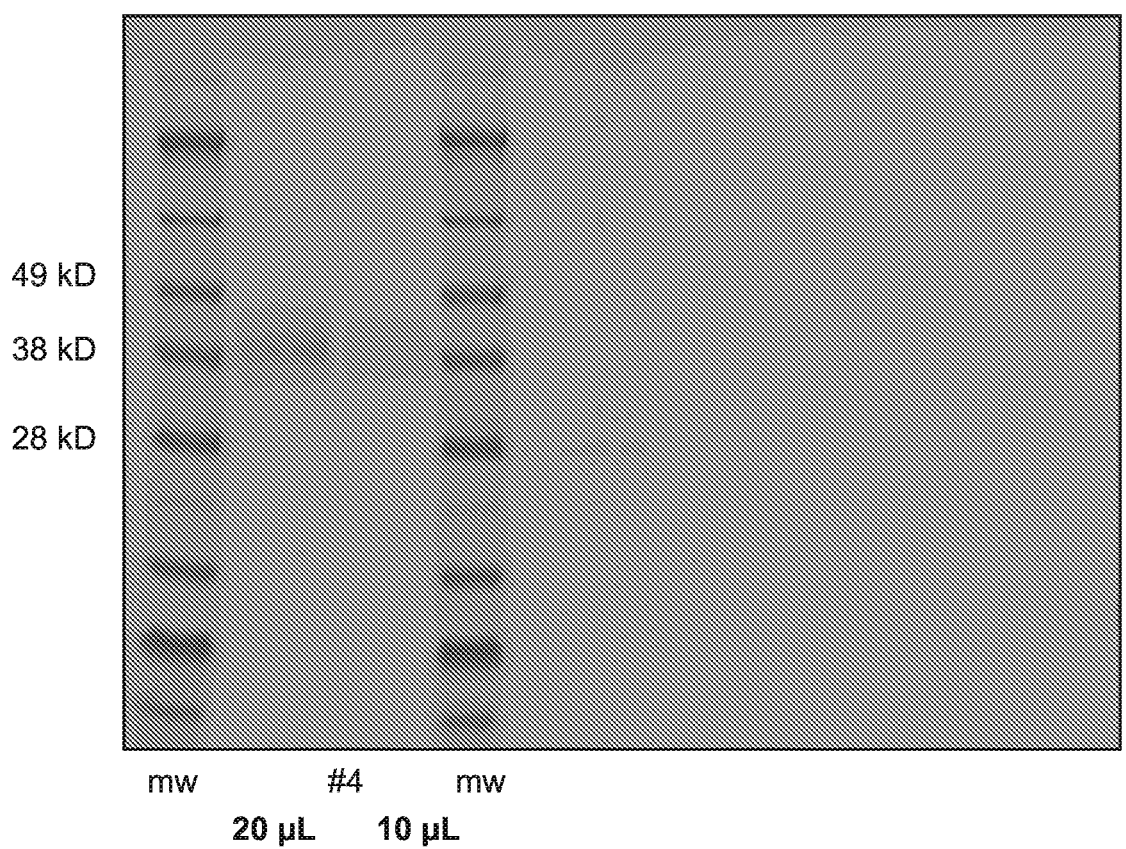
FIG. 51 illustrates Coomassie-stained SDS-PAGE of purified fractions E2-E3 for peptide-IL-15 agent complex of SEQ ID NO: 1318 (#4) after pooling and buffer exchange in PBS.

FIG. 50 illustrates Coomassie-stained SDS-PAGE of fractions obtained from the small-scale purification of SEQ ID NO: 1318. FIG. 51 illustrates Coomassie-stained SDS-PAGE of purified fractions E2-E3 after pooling and buffer exchange in PBS. Similar to SEQ ID NO: 1317 and SEQ ID NO: 1321, SEQ ID NO: 1318 bound and eluted from the nickel column and the purified form showed a band at approximately 38 kD by SDS-PAGE. This result was surprising since there was no significant band present when analyzed by Western Blot using anti-His antibody as described above, yet the His-Tag sequence was accessible to the nickel-charged chelate immobilized on the nickel column.

Purification of SEQ ID NO: 1319 and SEQ ID NO: 1320.

Figure 52:
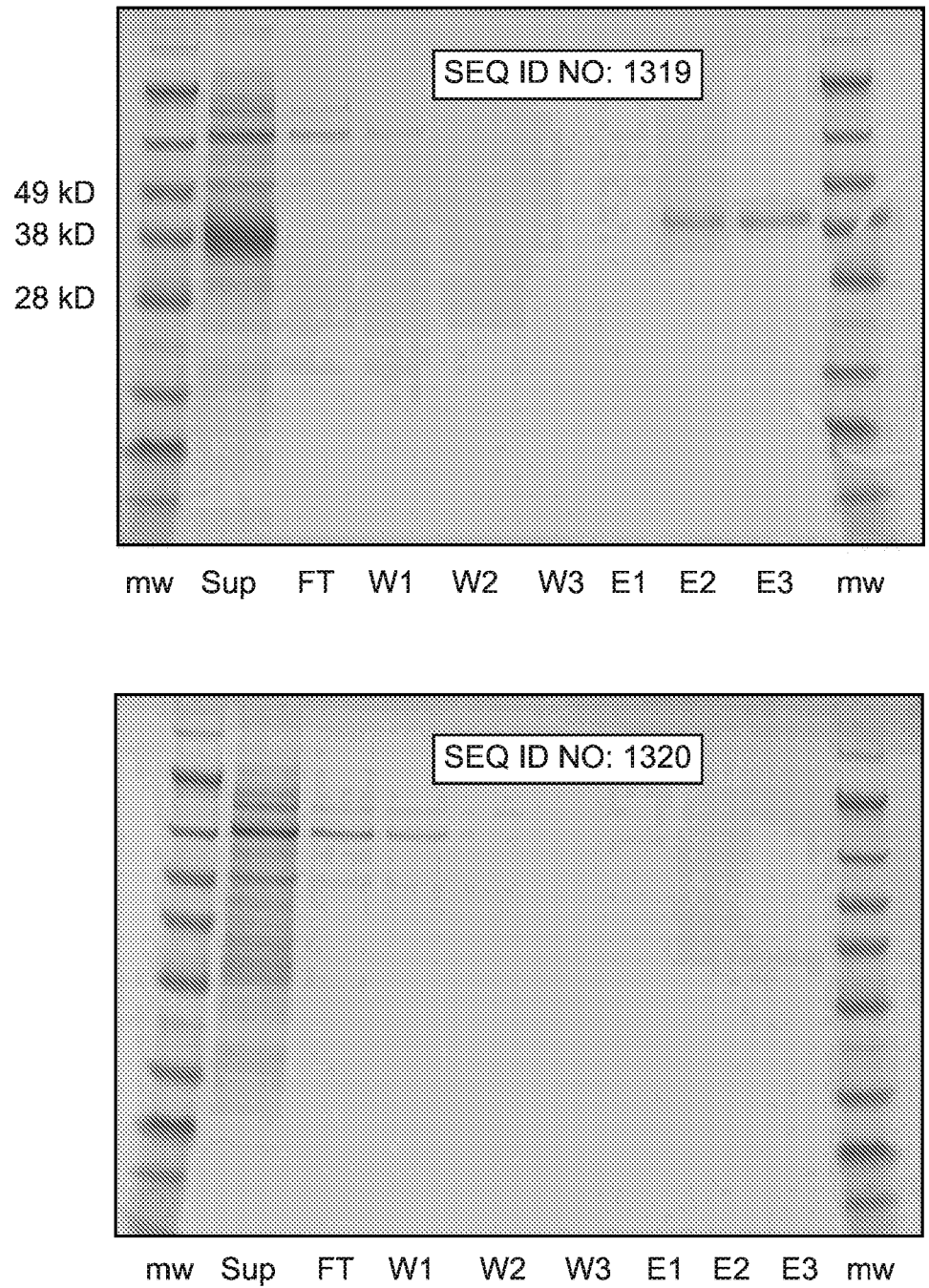
FIG. 52 illustrates Coomassie-stained SDS-PAGE of fractions obtained from the small-scale purification of SEQ ID NO: 1319 and SEQ ID NO: 1320.

FIG. 52 illustrates Coomassie-stained SDS-PAGE of fractions obtained from the small-scale purification of SEQ ID NO: 1319 and SEQ ID NO: 1320. Similar to SEQ ID NO: 1317, SEQ ID NO: 1318, and SEQ ID NO: 1321. SEQ ID NO: 1319 bound and eluted from the nickel column and the purified form showed a band at approximately 38 kD by SDS-PAGE; however, very little staining appeared by Coomassie-stained SDS-PAGE for SEQ ID NO: 1320. This is consistent with both the very faint bands in the same area for the starting material as well as the faint staining seen in the Western Blot analysis.

A summary of the purification of SEQ ID NO: 1317-SEQ ID NO: 1321 is shown in TABLE 11. Overall, the purification of each His-Tagged peptide-IL-15 agent complex was successful with prominent bands seen by Coomassie-stained SDS-PAGE for the high expressers and a final yield from 1 mL of starting material within a range of 80-130 µg.

TABLE 11

Summary of Small-Scale Purification of SEQ ID NO: 1317-SEQ ID NO: 1321

| SEQ ID NO | Conc mg/mL | Yield from 1 mL supernatant (ug) |
|---|---|---|
| SEQ ID NO: 1319 | 0.13 | 130 |
| SEQ ID NO: 1320 | 0.10 | 100 |
| SEQ ID NO: 1317 | 0.09 | 90 |
| SEQ ID NO: 1318 | 0.13 | 130 |
| SEQ ID NO: 1321 | 0.08 | 80 |

Figure 53:
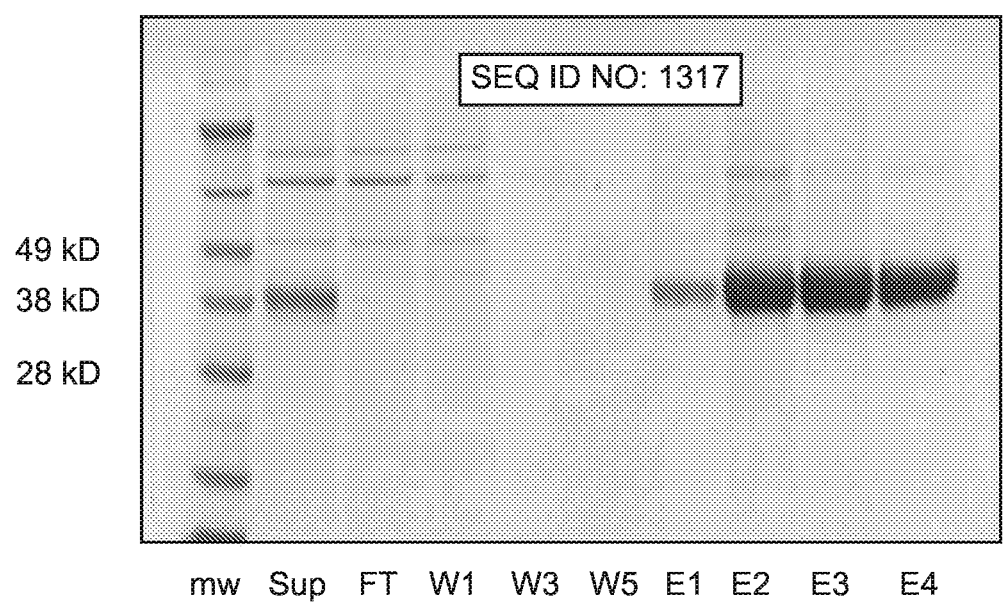
FIG. 53 illustrates Coomassie-stained SDS-PAGE of fractions obtained from the large-scale purification of SEQ ID NO: 1317 and SEQ ID NO: 1321.
Figure 53:
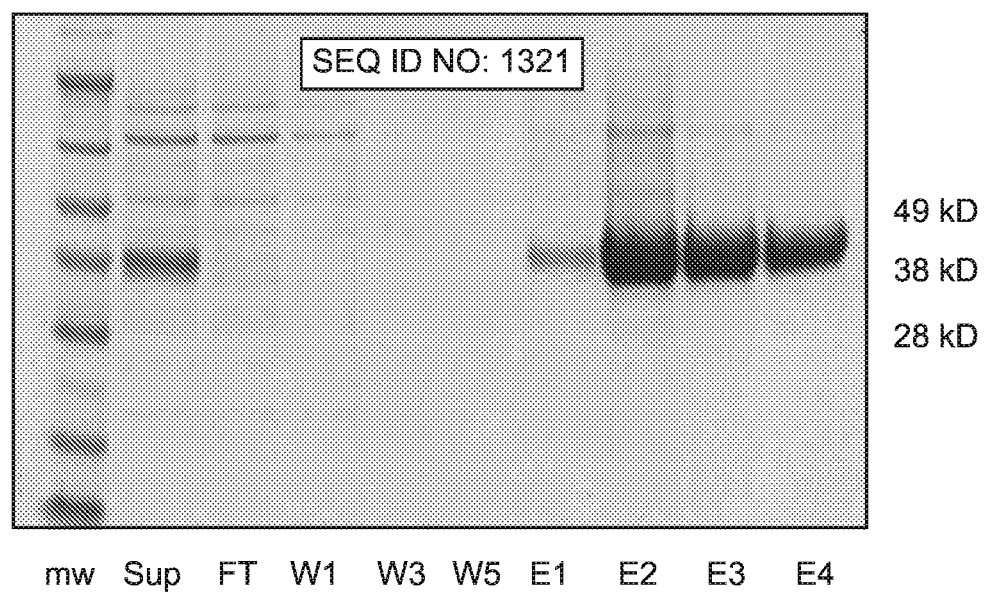
Figure 54:
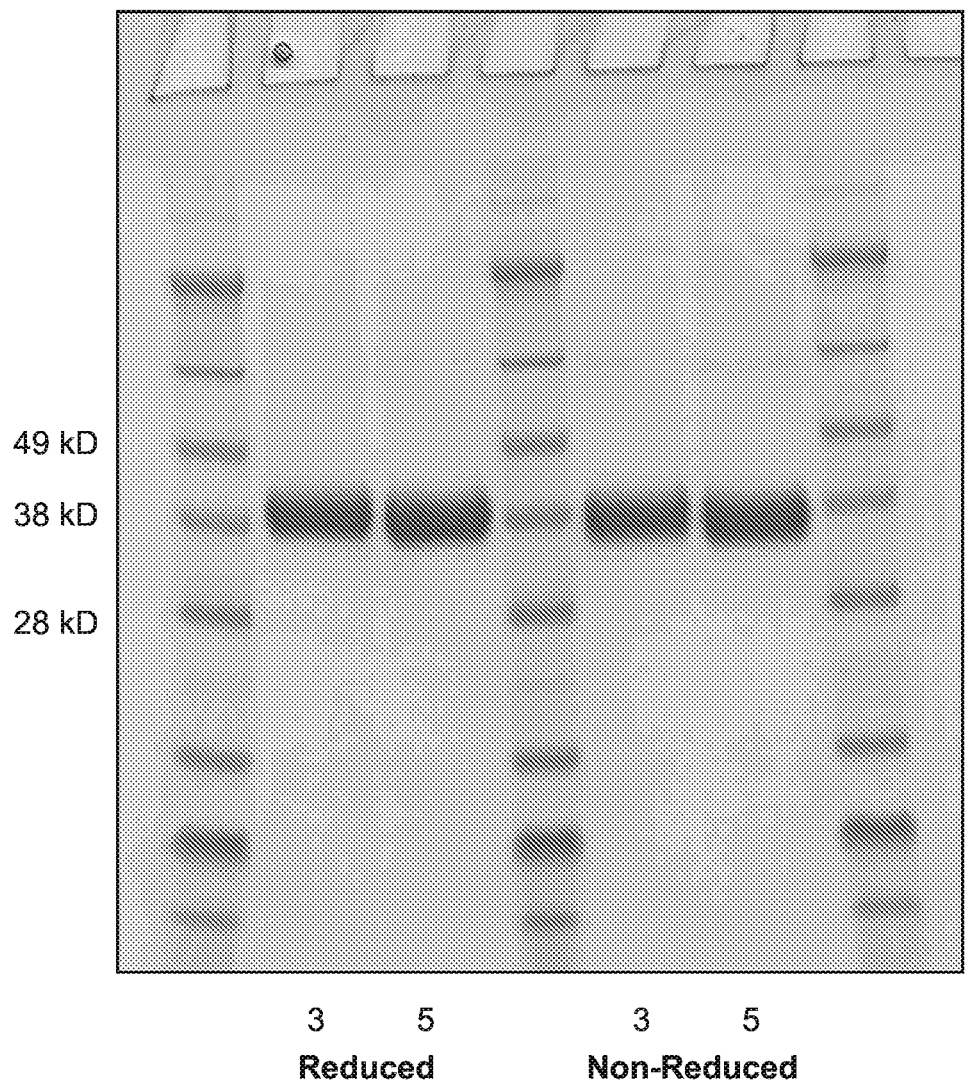
FIG. 54 illustrates Coomassie-stained SDS-PAGE of fractions E2-E4 for peptide-IL-15 agent complexes SEQ ID NO: 1317 (#3) and SEQ ID NO: 1321 (#5), which were pooled, buffer exchanged in PBS, and further analyzed under reducing and non-reducing conditions.
Figure 55:
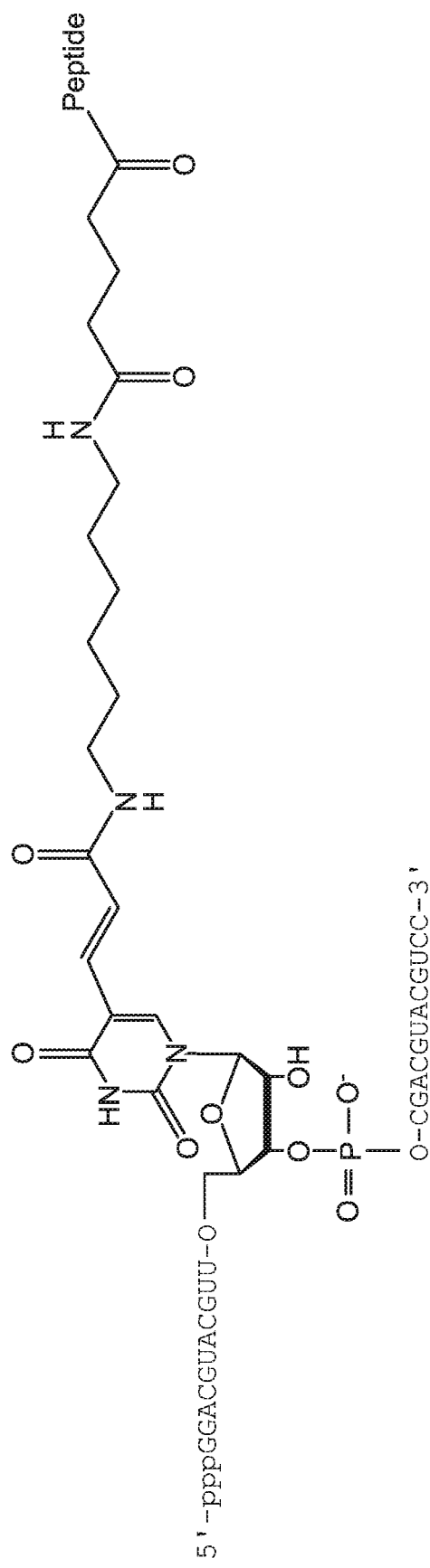
FIG. 55 illustrates a peptide-I/O complex of the present disclosure comprising a peptide of SEQ ID NO: 568 and an I/O comprising a dsRNA of SEQ ID NO: 1375 linked by a stable linker, where the linker is attached to a modified base in the dsRNA used as a conjugation or linkage site (e.g., as shown in the figure, a uridine in SEQ ID NO: 1375 is modified to be uridine with an extended amine attached to the linker, and the linker is also attached to the peptide (as denoted)). The dsRNA of SEQ ID NO: 1375 in this peptide-I/O complex has a 5'ppp (triphosphate) and is formed as a hairpin structure.
Figure 56:
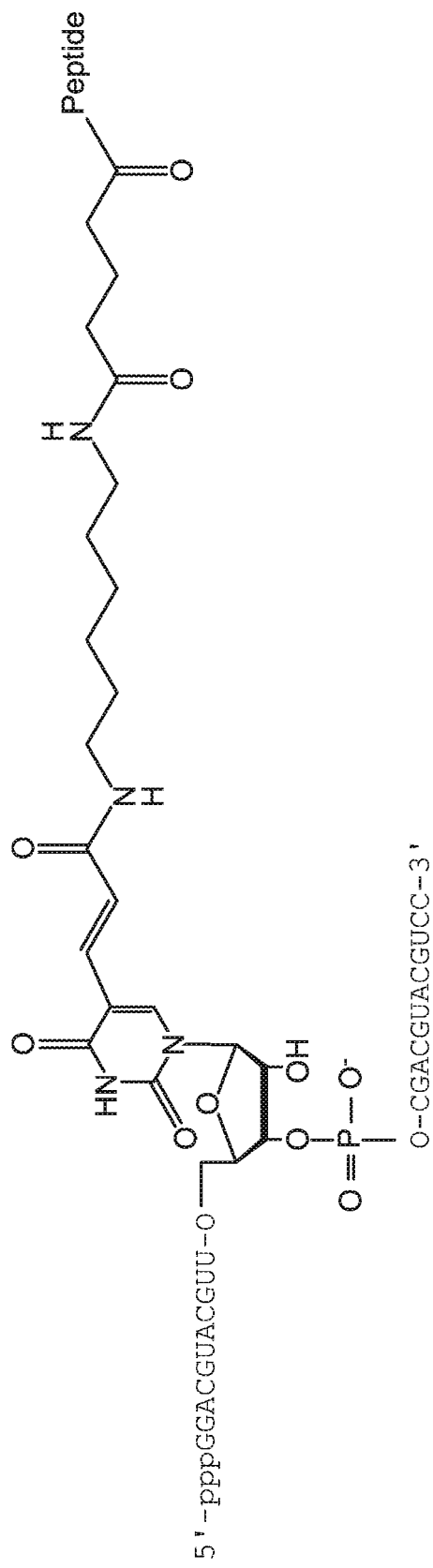
FIG. 56 illustrates a peptide I/O complex of the present disclosure comprising a peptide of SEQ ID NO: 569 and an I/O comprising a dsRNA of SEQ ID NO: 1375 linked by a stable linker, where the linker is attached to a modified base in the dsRNA used as a conjugation or linkage site (e.g., as shown in the figure, a uridine in SEQ ID NO: 1375 is modified to be uridine with an extended amine attached to the linker, and the linker is also attached to the peptide (as denoted)). The dsRNA of SEQ ID NO: 1375 in this peptide-I/O complex has a 5'ppp (triphosphate) and is formed as a hairpin structure.
Figure 57:
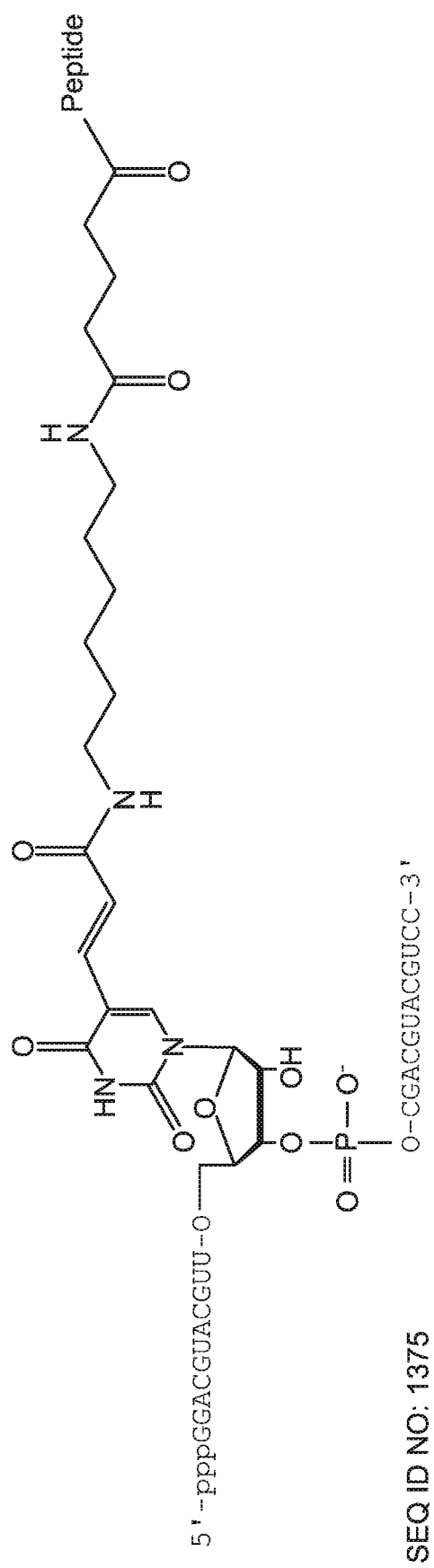
FIG. 57 illustrates a peptide I/O complex of the present disclosure comprising a peptide of SEQ ID NO: 570 and an I/O comprising a dsRNA of SEQ ID NO: 1375 linked by a stable linker, where the linker is attached to a modified base in the dsRNA used as a conjugation or linkage site (e.g., as shown in the figure, a uridine in SEQ ID NO: 1375 is modified to be uridine with an extended amine attached to the linker, and the linker is also attached to the peptide (as denoted)). The dsRNA of SEQ ID NO: 1375 in this peptide-I/O complex has a 5'ppp (triphosphate) and is formed as a hairpin structure.
Figure 58:
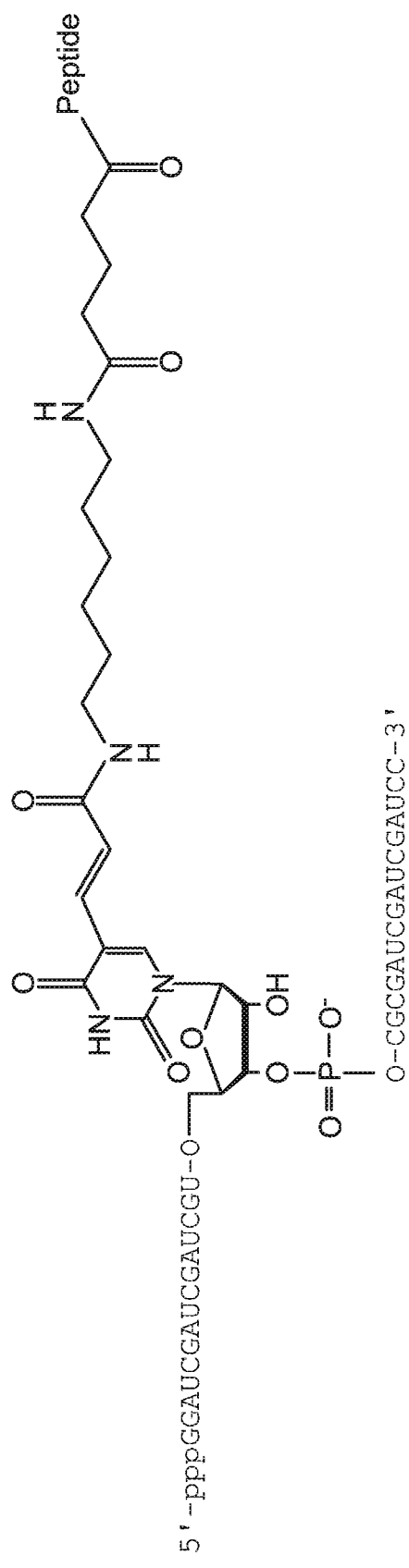
FIG. 58 illustrates a peptide-I/O complex of the present disclosure comprising a peptide of SEQ ID NO: 568 and an I/O comprising a dsRNA of SEQ ID NO: 1376 linked by a stable linker, where the linker is attached to a modified base in the dsRNA used as a conjugation or linkage site (e.g., as shown in the figure, a uridine in SEQ ID NO: 1376 is modified to be uridine with an extended amine attached to the linker, and the linker is also attached to the peptide (as denoted)). The dsRNA of SEQ ID NO: 1376 in this peptide-I/O complex has a 5'ppp (triphosphate) and is formed as a hairpin structure.
Figure 59:
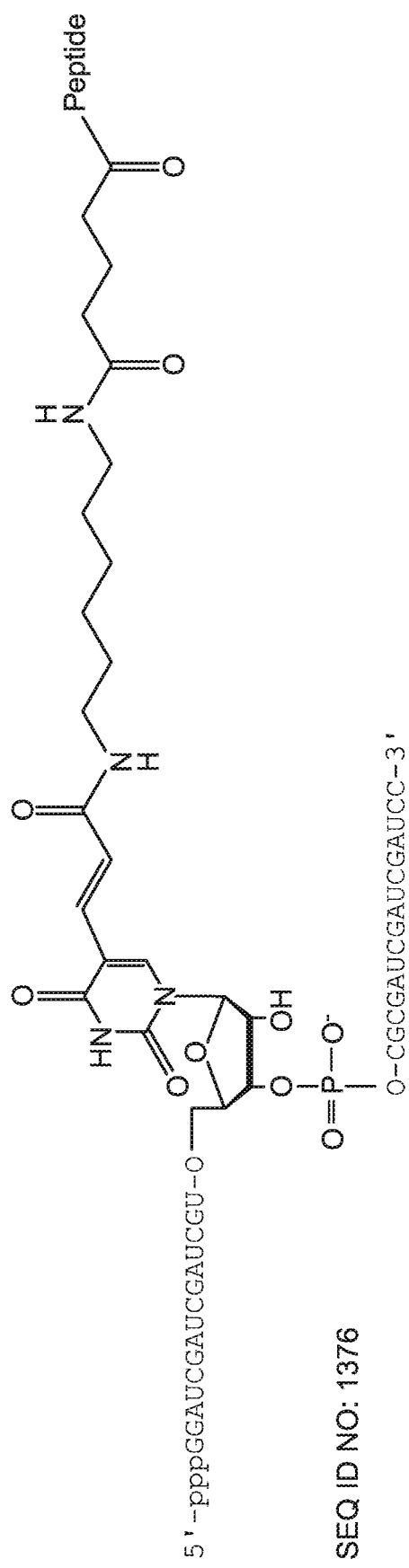
FIG. 59 illustrates a peptide I/O complex of the present disclosure comprising a peptide of SEQ ID NO: 569 and an I/O comprising a dsRNA of SEQ ID NO: 1376 linked by a stable linker, where the linker is attached to a modified base in the dsRNA used as a conjugation or linkage site (e.g., as shown in the figure, a uridine in SEQ ID NO: 1376 is modified to be uridine with an extended amine attached to the linker, and the linker is also attached to the peptide (as denoted)). The dsRNA of SEQ ID NO: 1376 in this peptide-I/O complex has a 5'ppp (triphosphate) and is formed as a hairpin structure.
Figure 60:
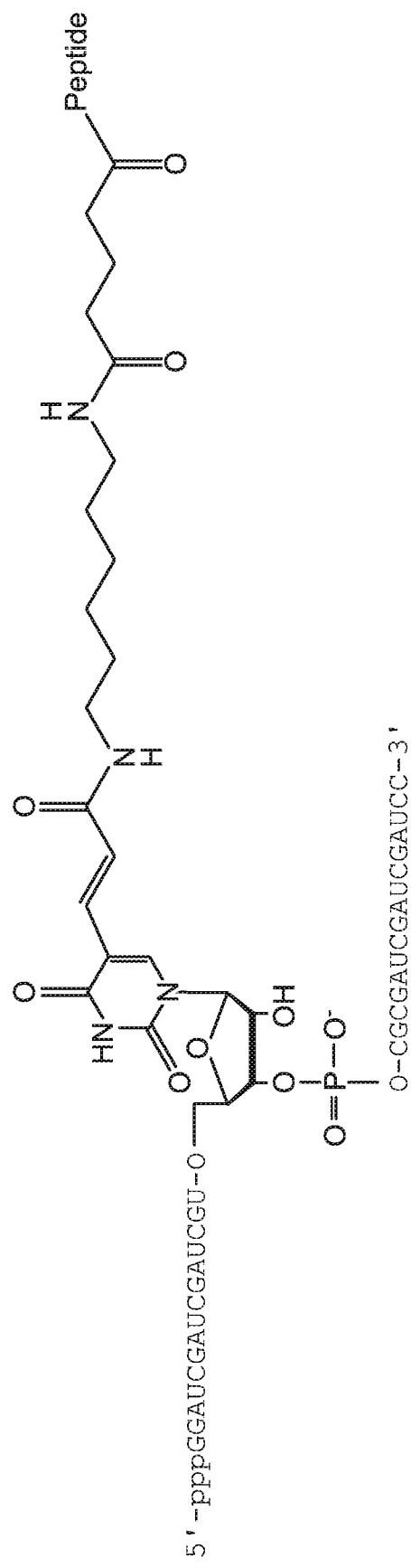
FIG. 60 illustrates a peptide I/O complex of the present disclosure comprising a peptide of SEQ ID NO: 570 and an I/O comprising a dsRNA of SEQ ID NO: 1376 linked by a stable linker where the linker is attached to a modified base in the dsRNA used as a conjugation or linkage site (e.g., as shown in the figure, a uridine in SEQ ID NO: 1376 is modified to be uridine with an extended amine attached to the linker, and the linker is also attached to the peptide (as denoted)). The dsRNA of SEQ ID NO: 1376 in this peptide-I/O complex has a 5'ppp (triphosphate) and is formed as a hairpin structure.
Figure 61:
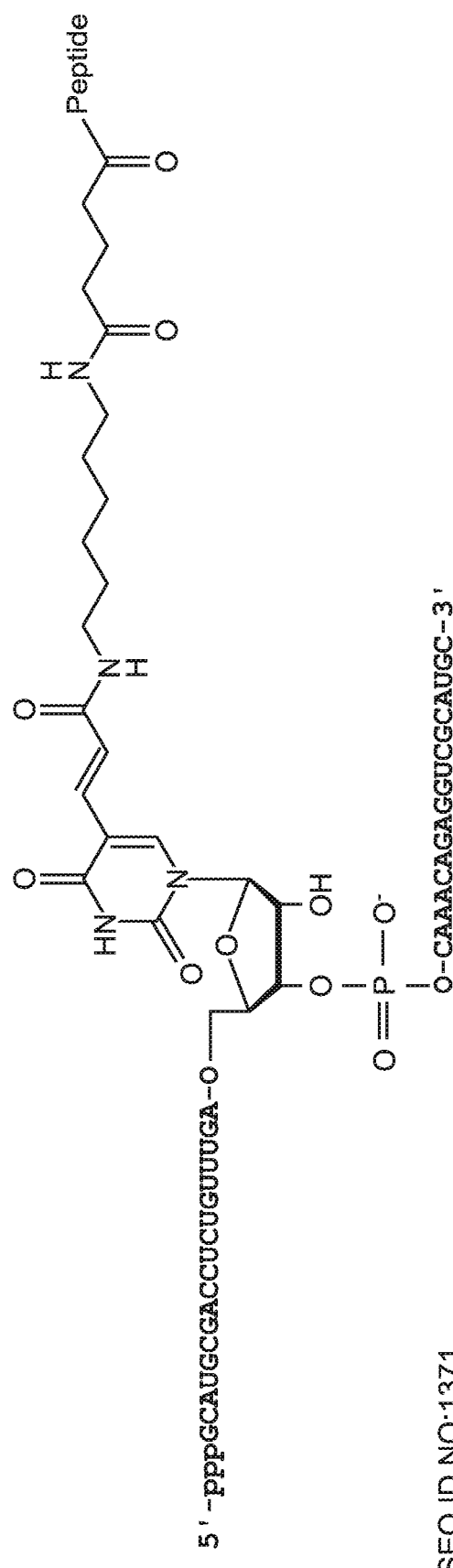
FIG. 61 illustrates a peptide-I/O complex of the present disclosure comprising a peptide of SEQ ID NO: 568 and an I/O comprising a dsRNA of SEQ ID NO: 1371 linked by a stable linker, where the linker is attached to a modified base in the dsRNA used as a conjugation or linkage site (e.g., as shown in the figure, a uridine in SEQ ID NO: 1371 is modified to be uridine with an extended amine attached to the linker, and the linker is also attached to the peptide (as denoted)). The dsRNA of SEQ ID NO: 1371 in this peptide-I/O complex has a 5'ppp (triphosphate) and is formed as a hairpin structure.
Figure 62:
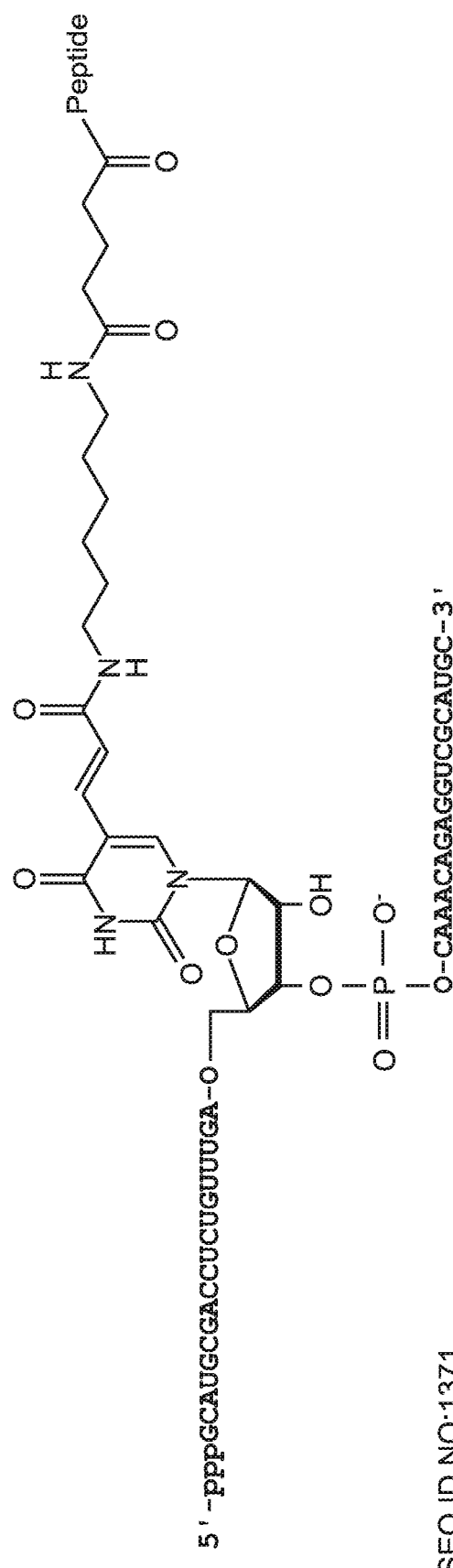
FIG. 62 illustrates a peptide-I/O complex of the present disclosure comprising a peptide of SEQ ID NO: 569 and an I/O comprising a dsRNA of SEQ ID NO: 1371 linked by a stable linker, where the linker is attached to a modified base in the dsRNA used as a conjugation or linkage site (e.g., as shown in the figure, a uridine in SEQ ID NO: 1371 is modified to be uridine with an extended amine attached to the linker, and the linker is also attached to the peptide (as denoted)). The dsRNA of SEQ ID NO: 1371 in this peptide-I/O complex has a 5'ppp (triphosphate) and is formed as a hairpin structure.
Figure 63:
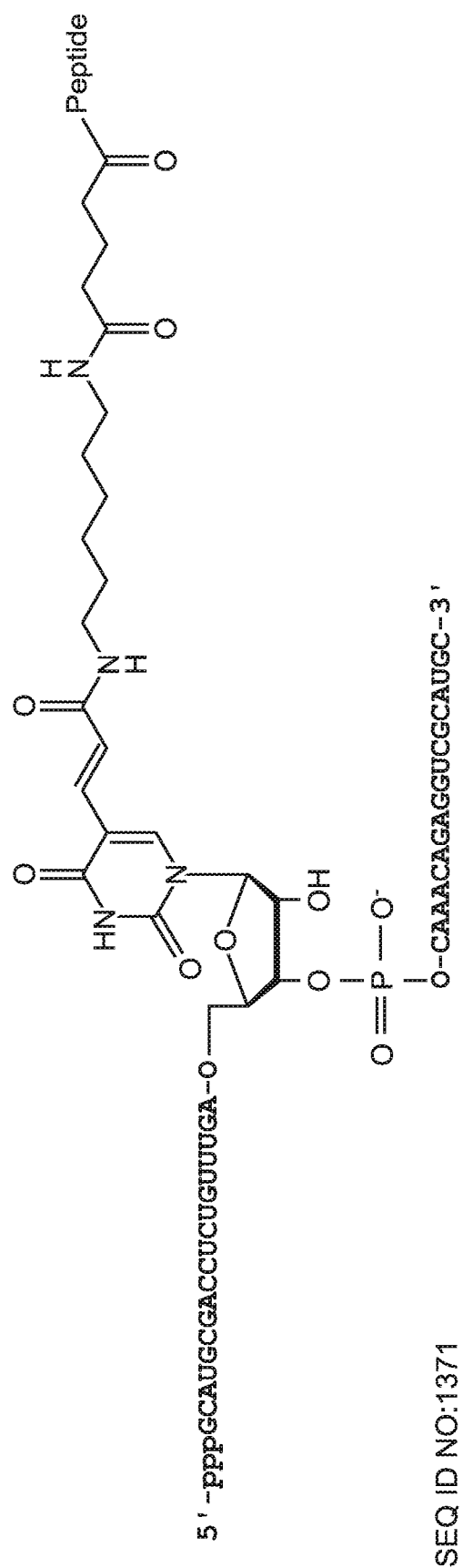
FIG. 63 illustrates a peptide-I/O complex of the present disclosure comprising a peptide of SEQ ID NO: 570 and an I/O comprising a dsRNA of SEQ ID NO: 1371 linked by a stable linker, where the linker is attached to a modified base in the dsRNA used as a conjugation or linkage site (e.g., as shown in the figure, a uridine in SEQ ID NO: 1371 is modified to be uridine with an extended amine attached to the linker, and the linker is also attached to the peptide (as denoted)). The dsRNA of SEQ ID NO: 1371 in this peptide-I/O complex has a 5'ppp (triphosphate) and is formed as a hairpin structure.
Figure 64:
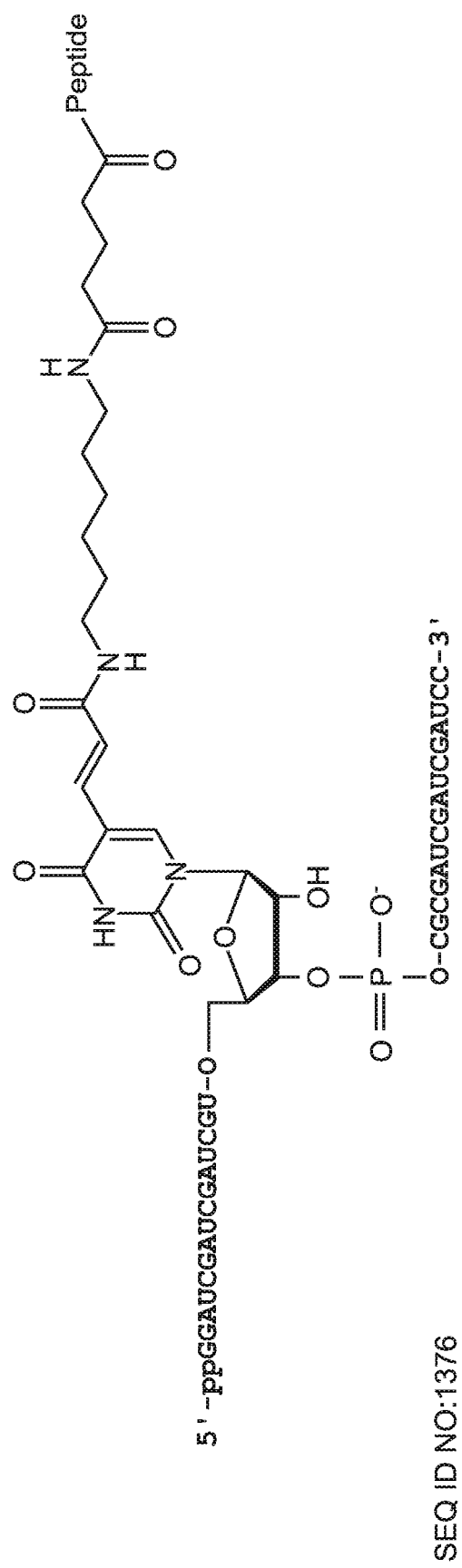
FIG. 64 illustrates a peptide-I/O complex of the present disclosure comprising a peptide of SEQ ID NO: 568 and an I/O comprising a dsRNA of SEQ ID NO: 1376 linked by a stable linker, where the linker is attached to a modified base in the dsRNA used as a conjugation or linkage site (e.g., as shown in the figure, a uridine in SEQ ID NO: 1376 is modified to be uridine with an extended amine attached to the linker, and the linker is also attached to the peptide (as denoted)). The dsRNA of SEQ ID NO: 1376 in this peptide-I/O complex has a 5'pp (diphosphate) and is formed as a hairpin structure.
Figure 65:
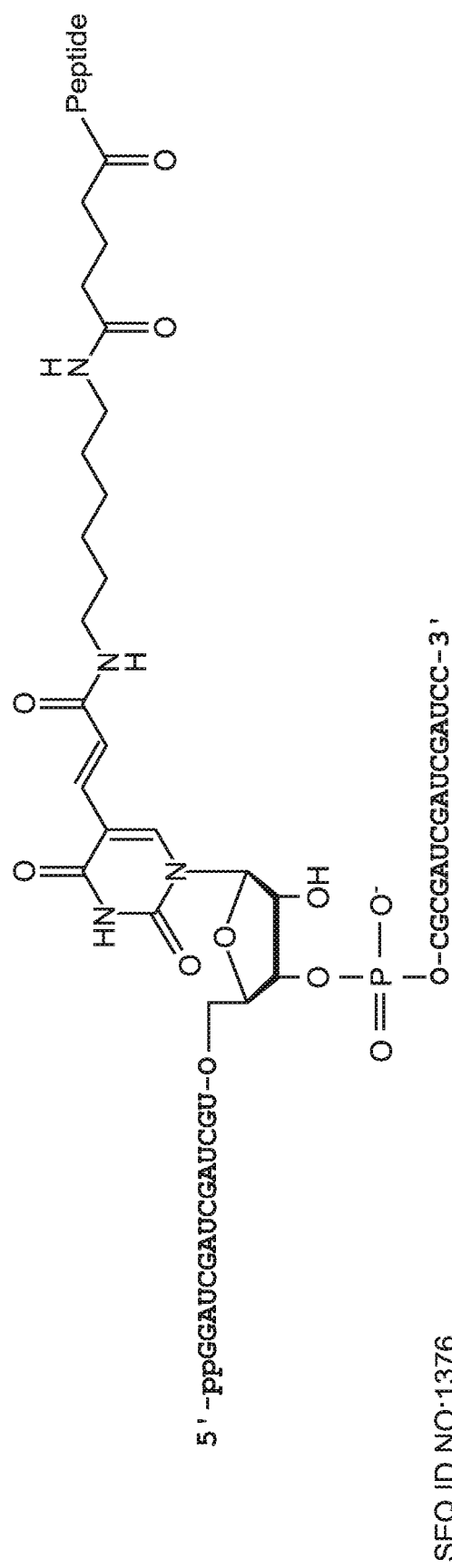
FIG. 65 illustrates a peptide-I/O complex of the present disclosure comprising a peptide of SEQ ID NO: 569 and an I/O comprising a dsRNA of SEQ ID NO: 1376 linked by a stable linker, where the linker is attached to a modified base in the dsRNA used as a conjugation or linkage site (e.g., as shown in the figure, a uridine in SEQ ID NO: 1376 is modified to be uridine with an extended amine attached to the linker, and the linker is also attached to the peptide (as denoted)). The dsRNA of SEQ ID NO: 1376 in this peptide-I/O complex has a 5'pp (diphosphate) and is formed as a hairpin structure.
Figure 66:
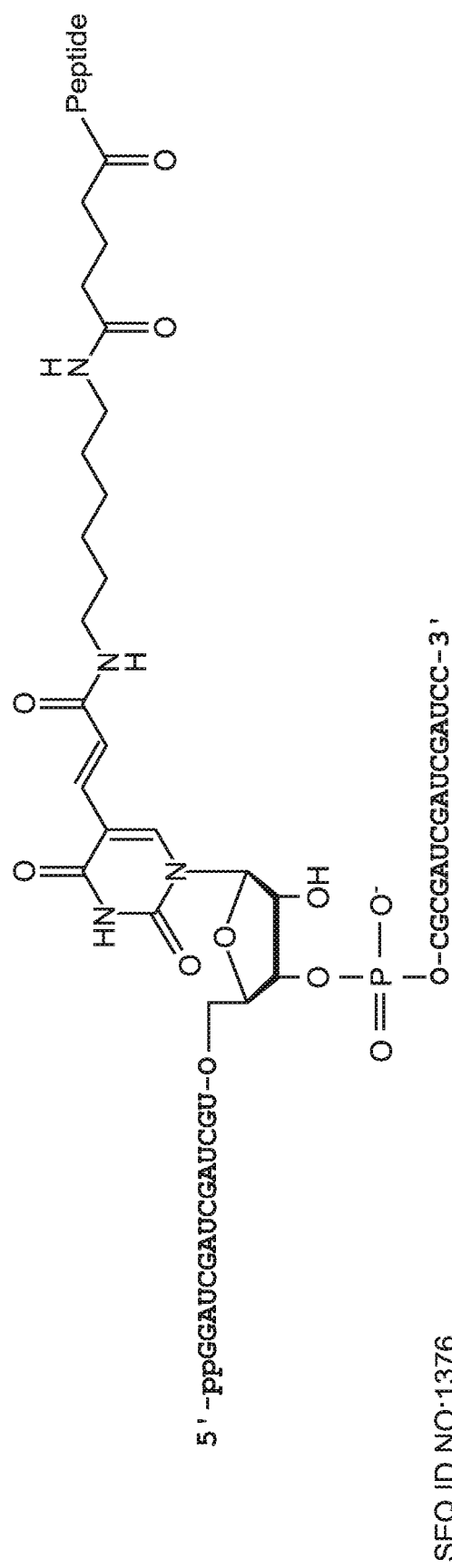
FIG. 66 illustrates a peptide-I/O complex of the present disclosure comprising a peptide of SEQ ID NO: 570 and an I/O comprising a dsRNA of SEQ ID NO: 1376 linked by a stable linker, where the linker is attached to a modified base in the dsRNA used as a conjugation or linkage site (e.g., as shown in the figure, a uridine in SEQ ID NO: 1376 is modified to be uridine with an extended amine attached to the linker, and the linker is also attached to the peptide (as denoted)). The dsRNA of SEQ ID NO: 1376 in this peptide-I/O complex has a 5'pp (diphosphate) and is formed as a hairpin structure.
Figure 67:
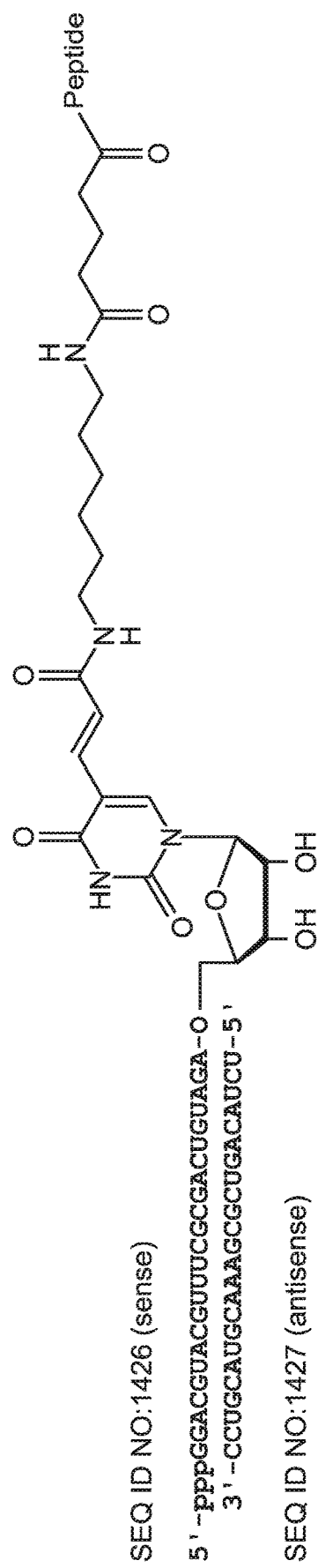
FIG. 67 illustrates a peptide-I/O complex of the present disclosure comprising a peptide of SEQ ID NO: 568 and an I/O comprising a dsRNA of two separate RNA strands complexed together comprising SEQ ID NO: 1426 and SEQ ID NO: 1427 (where 5'ppp is located on seq id no 1426) linked by a stable linker, where the linker is attached to a modified base appended to the dsRNA used as a conjugation or linkage site (e.g., as shown in the figure, a uridine appended to SEQ ID NO: 1426 is modified to be uridine with an extended amine attached to the linker, and the linker is also attached to the peptide (as denoted)).
Figure 68:
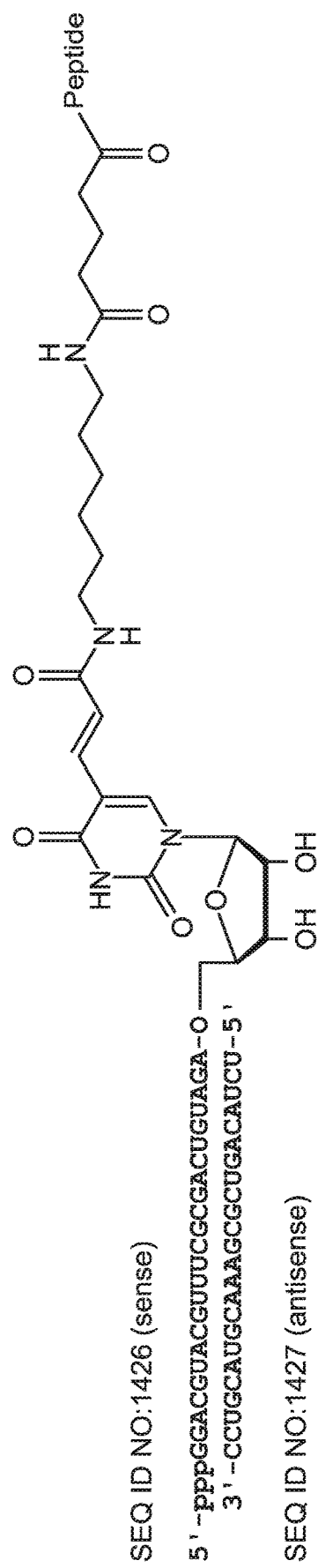
FIG. 68 illustrates a peptide-I/O complex of the present disclosure comprising a peptide of SEQ ID NO: 569 and an I/O comprising a dsRNA of two separate RNA strands complexed together comprising SEQ ID NO: 1426 and SEQ ID NO: 1427 (where 5'ppp is located on seq id no 1426) linked by a stable linker, where the linker is attached to a modified base appended to the dsRNA used as a conjugation or linkage site (e.g., as shown in the figure, a uridine appended to SEQ ID NO: 1426 is modified to be uridine with an extended amine attached to the linker, and the linker is also attached to the peptide (as denoted)).
Figure 69:
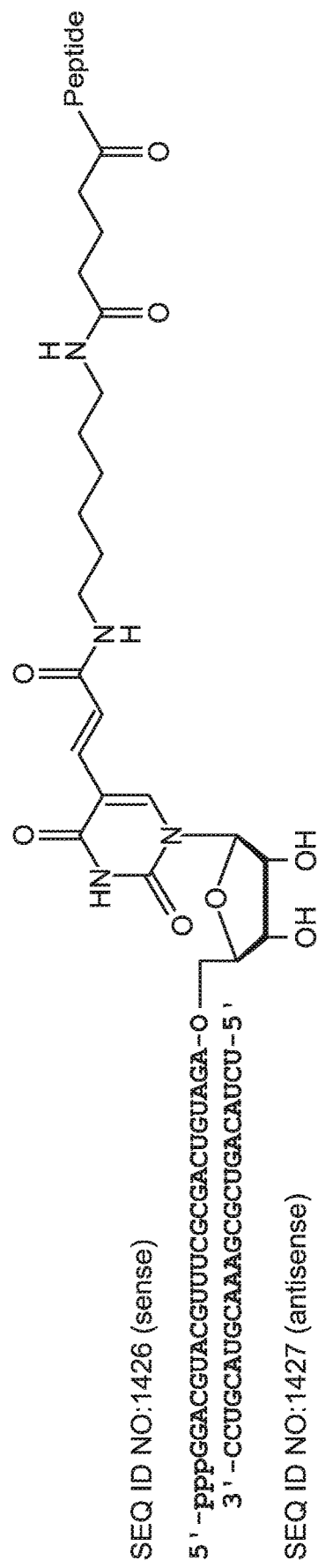
FIG. 69 illustrates a peptide-I/O complex of the present disclosure comprising a peptide of SEQ ID NO: 570 and an I/O comprising a dsRNA of two separate RNA strands complexed together comprising SEQ ID NO: 1426 and SEQ ID NO: 1427 (where 5'ppp is located on seq id no 1426) linked by a stable linker, where the linker is attached to a modified base appended to the dsRNA used as a conjugation or linkage site (e.g., as shown in the figure, a uridine appended to SEQ ID NO: 1426 is modified to be uridine with an extended amine attached to the linker, and the linker is also attached to the peptide (as denoted)).
Figure 70:
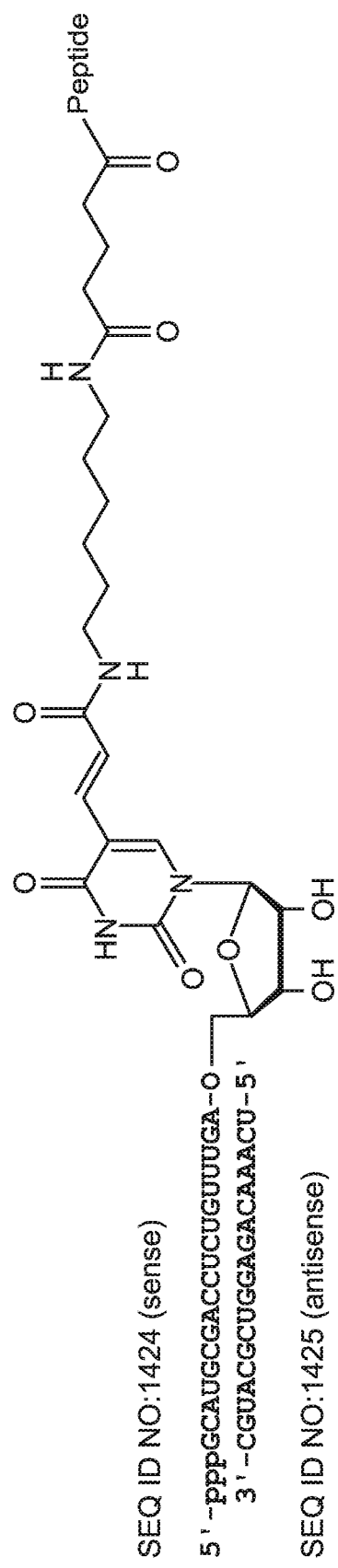
FIG. 70 illustrates a peptide-I/O complex of the present disclosure comprising a peptide of SEQ ID NO: 568 and an I/O comprising a dsRNA of two separate RNA strands complexed together comprising SEQ ID NO: 1424 and SEQ ID NO: 1425 (where 5'ppp is located on seq id no 1424) linked by a stable linker, where the linker is attached to a modified base appended to the dsRNA used as a conjugation or linkage site (e.g., as shown in the figure, a uridine appended to SEQ ID NO: 1424 is modified to be uridine with an extended amine attached to the linker, and the linker is also attached to the peptide (as denoted)). The I/O comprising a dsRNA of two separate RNA strands complexed together comprising SEQ ID NO: 1424 and SEQ ID NO: 1425 (where 5'ppp is located on seq id no 1424) is also denoted as "5'ppp dsRNA" in FIG. 81.
Figure 71:
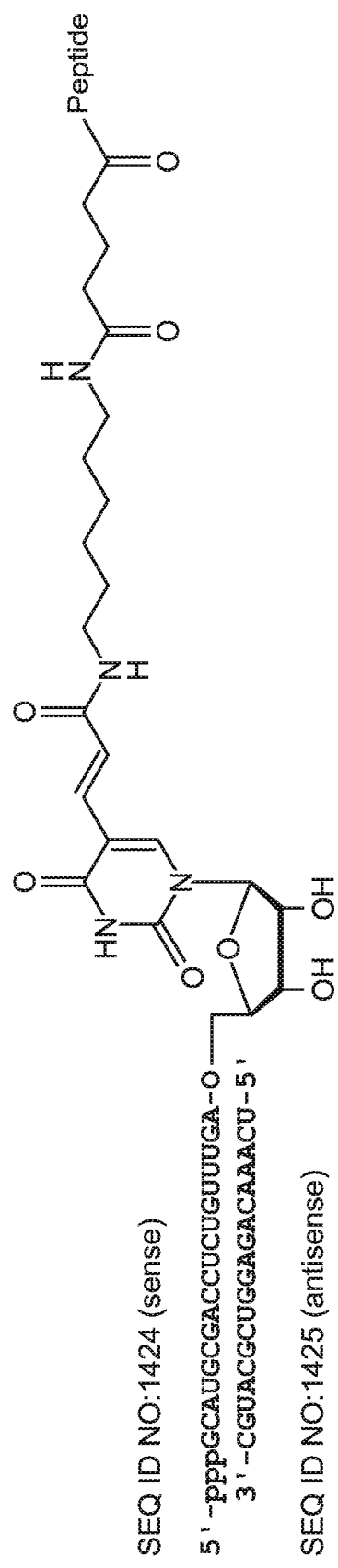
FIG. 71 illustrates a peptide-I/O complex of the present disclosure comprising a peptide of SEQ ID NO: 569 and an I/O comprising a dsRNA of two separate RNA strands complexed together comprising SEQ ID NO: 1424 and SEQ ID NO: 1425 (where 5'ppp is located on seq id no 1424) linked by a stable linker, where the linker is attached to a modified base appended to the dsRNA used as a conjugation or linkage site (e.g., as shown in the figure, a uridine appended to SEQ ID NO: 1424 is modified to be uridine with an extended amine attached to the linker, and the linker is also attached to the peptide (as denoted)).
Figure 72:
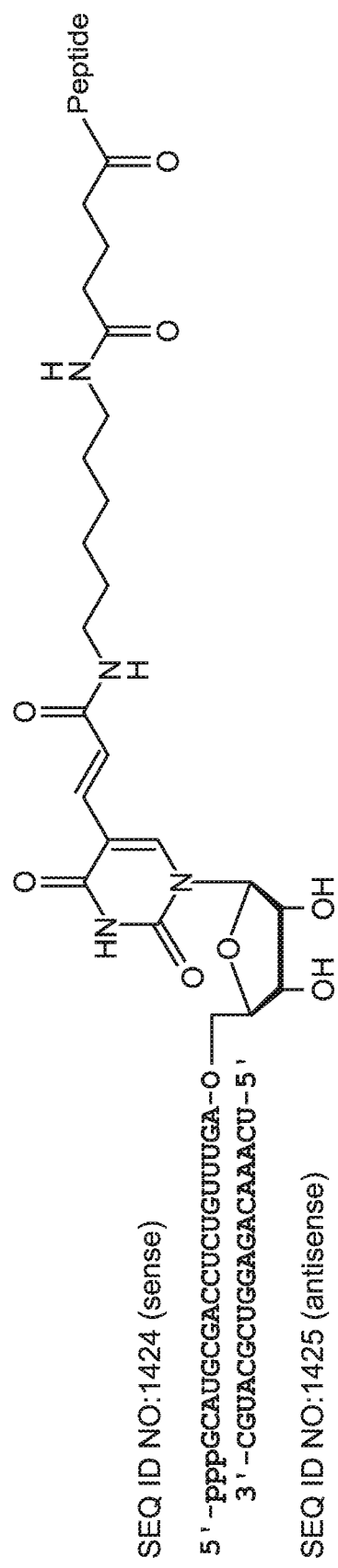
FIG. 72 illustrates a peptide-I/O complex of the present disclosure comprising a peptide of SEQ ID NO: 570 and an I/O comprising a dsRNA of two separate RNA strands complexed together comprising SEQ ID NO: 1424 and SEQ ID NO: 1425 (where 5'ppp is located on seq id no 1424) linked by a stable linker, where the linker is attached to a modified base appended to the dsRNA used as a conjugation or linkage site (e.g., as shown in the figure, a uridine appended to SEQ ID NO: 1424 is modified to be uridine with an extended amine attached to the linker, and the linker is also attached to the peptide (as denoted)).
Figure 73:
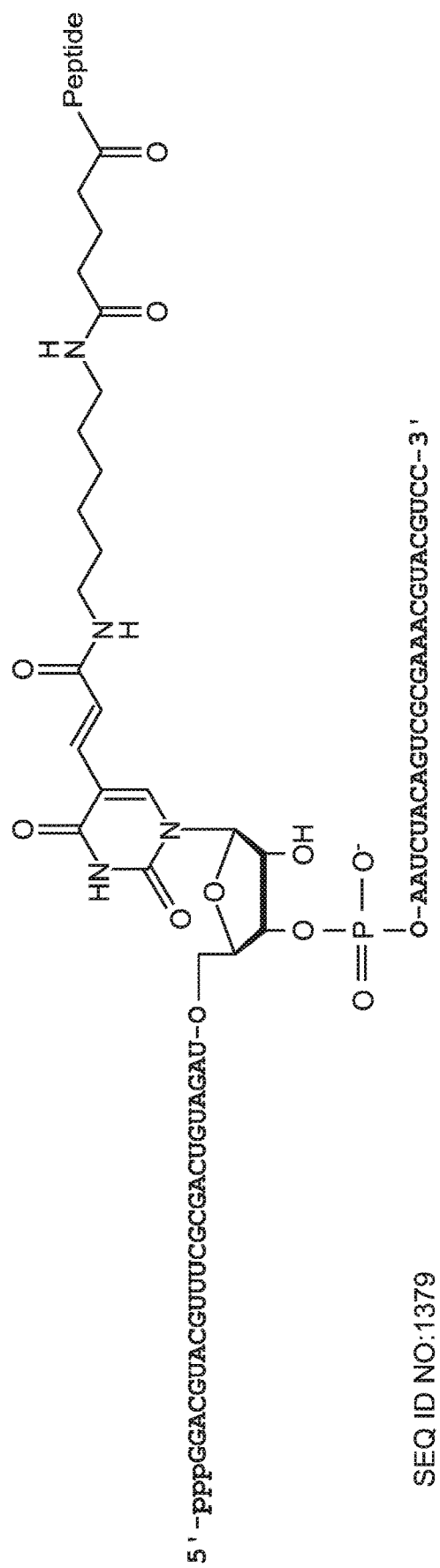
FIG. 73 illustrates a peptide-I/O complex of the present disclosure comprising a peptide of SEQ ID NO: 568 and an I/O of SEQ ID NO: 1379 linked by a stable linker, where the linker is attached to a modified base in the dsRNA used as a conjugation or linkage site (e.g., as shown in the figure, a uridine in SEQ ID NO:1379 is modified to be uridine with an extended amine attached to the linker, and the linker is also attached to the peptide (as denoted)). The dsRNA of SEQ ID NO: 1379 in this peptide-I/O complex has a 5'ppp (triphosphate) and is formed as a hairpin structure.
Figure 74:
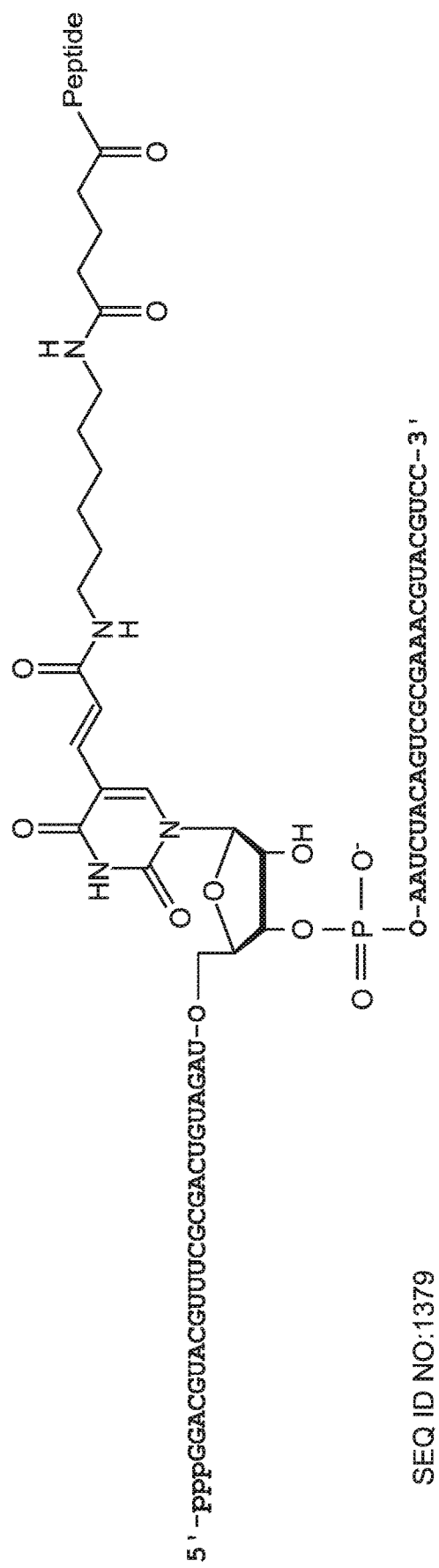
FIG. 74 illustrates a peptide-I/O complex of the present disclosure comprising a peptide of SEQ ID NO: 569 and an I/O of SEQ ID NO: 1379 linked by a stable linker, where the linker is attached to a modified base in the dsRNA used as a conjugation or linkage site (e.g., as shown in the figure, a uridine in SEQ ID NO:1371 is modified to be uridine with an extended amine attached to the linker, and the linker is also attached to the peptide (as denoted)). The dsRNA of SEQ ID NO: 1379 in this peptide-I/O complex has a 5'ppp (triphosphate) and is formed as a hairpin structure.
Figure 75:
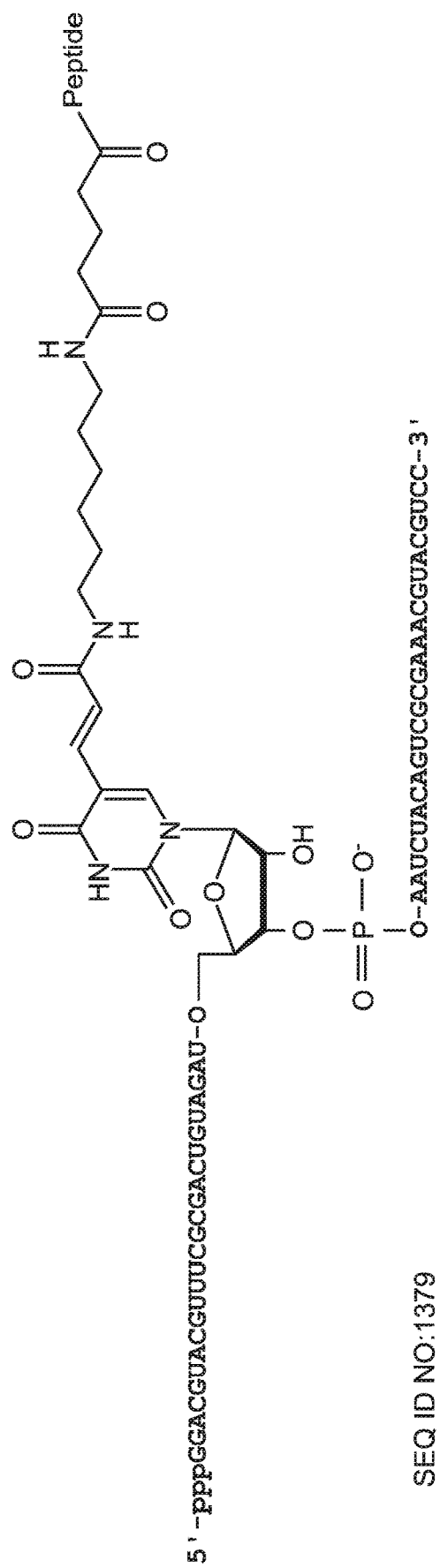
FIG. 75 illustrates a peptide-I/O complex of the present disclosure comprising a peptide of SEQ ID NO: 570 and an I/O of SEQ ID NO: 1379 linked by a stable linker, where the linker is attached to a modified base in the dsRNA used as a conjugation or linkage site (e.g., as shown in the figure, a uridine in SEQ ID NO:1371 is modified to be uridine with an extended amine attached to the linker, and the linker is also attached to the peptide (as denoted)). The dsRNA of SEQ ID NO: 1379 in this peptide-I/O complex has a 5'ppp (triphosphate) and is formed as a hairpin structure.
Figure 76:
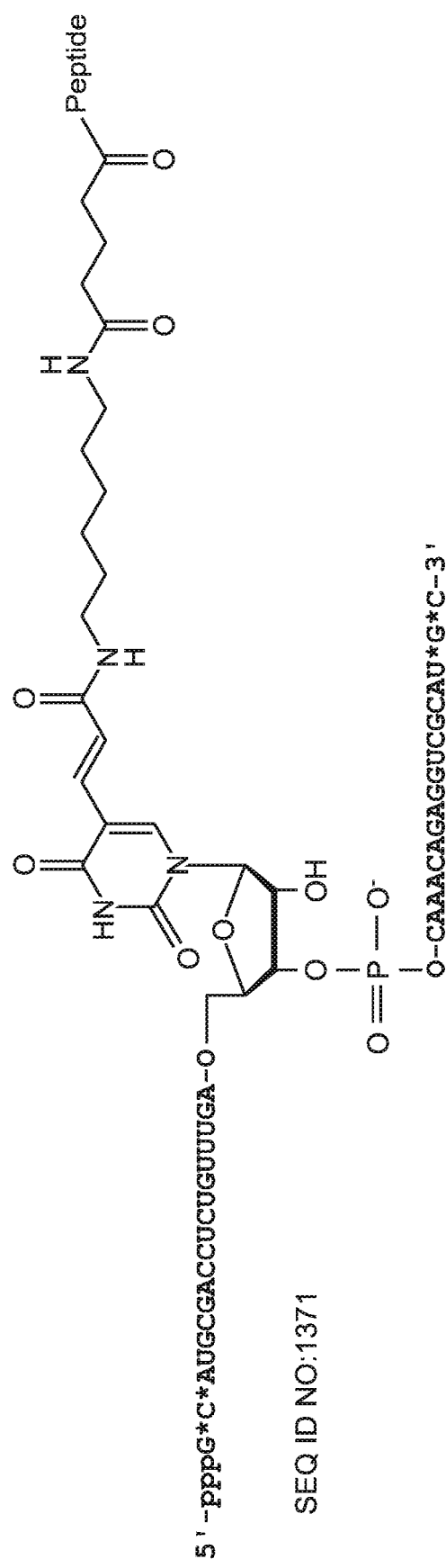
FIG. 76 illustrates a peptide-I/O complex of the present disclosure comprising a peptide of SEQ ID NO: 569 and an I/O of SEQ ID NO: 1371 (with phosphorothioate linkages as denoted by an asterix (*)) linked by a stable linker, where the linker is attached to a modified base in the dsRNA used as a conjugation or linkage site (e.g., as shown in the figure, a uridine in SEQ ID NO:1371 is modified to be uridine with an extended amine attached to the linker, and the linker is also attached to the peptide (as denoted)). The dsRNA of SEQ ID NO: 1371 in this peptide-I/O complex has a 5'ppp (triphosphate) and is formed as a hairpin structure.
Figure 77:
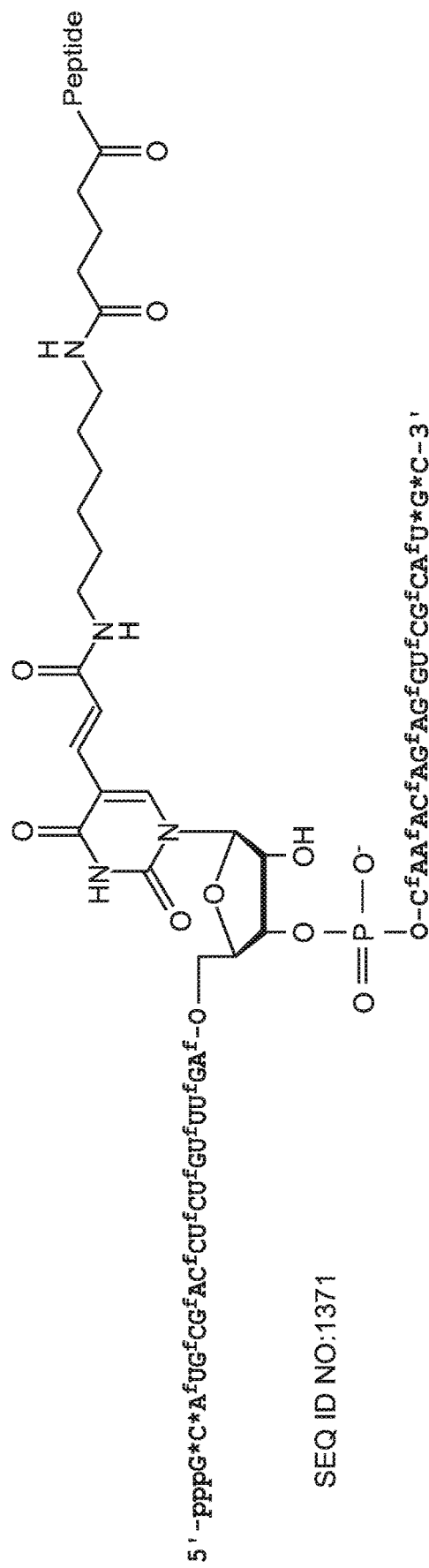
FIG. 77 illustrates a peptide-I/O complex of the present disclosure comprising a peptide of SEQ ID NO: 569 and an I/O of SEQ ID NO: 1371 (with phosphorothioate linkages and 2' fluoro RNA as denoted respectively by an asterix (*) and letter "f") linked by a stable linker, where the linker is attached to a modified base in the dsRNA used as a conjugation or linkage site (e.g., as shown in the figure, a uridine in SEQ ID NO:1371 is modified to be uridine with an extended amine attached to the linker, and the linker is also attached to the peptide (as denoted)). The dsRNA of SEQ ID NO: 1371 in this peptide-I/O complex has a 5'ppp (triphosphate) and is formed as a hairpin structure.
Figure 78:
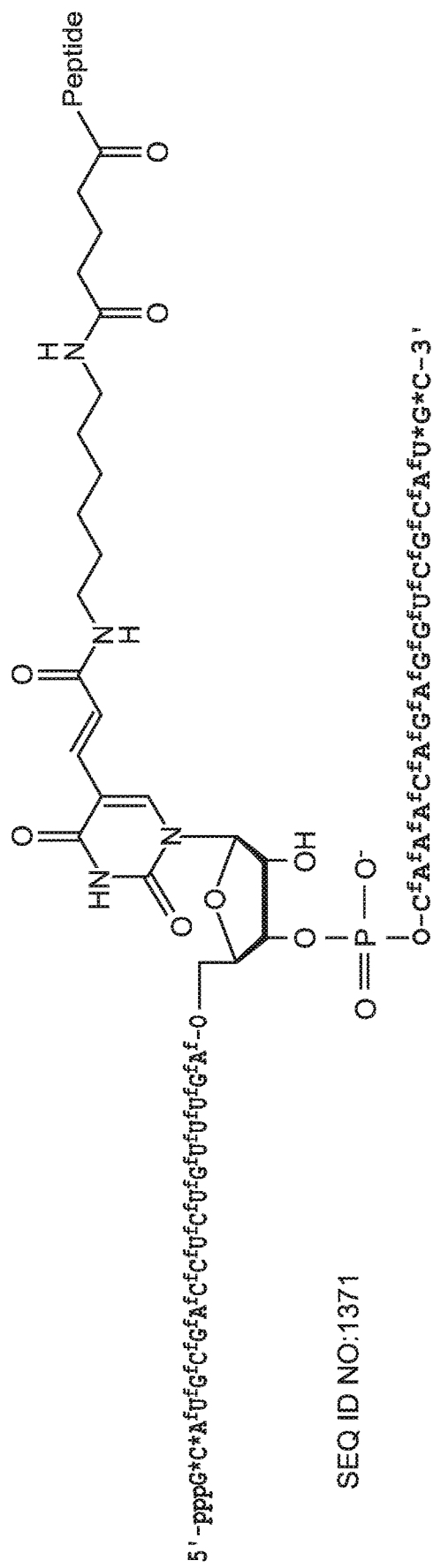
FIG. 78 illustrates a peptide-I/O complex of the present disclosure comprising a peptide of SEQ ID NO: 569 and an I/O of SEQ ID NO: 1371 (with phosphorothioate linkages and 2' fluoro RNA as denoted respectively by an asterix (*) and letter "f") linked by a stable linker, where the linker is attached to a modified base in the dsRNA used as a conjugation or linkage site (e.g., as shown in the figure, a uridine in SEQ ID NO:1371 is modified to be uridine with an extended amine attached to the linker, and the linker is also attached to the peptide (as denoted)). The dsRNA of SEQ ID NO: 1371 in this peptide-I/O complex has a 5'ppp (triphosphate) and is formed as a hairpin structure.
Figure 79:
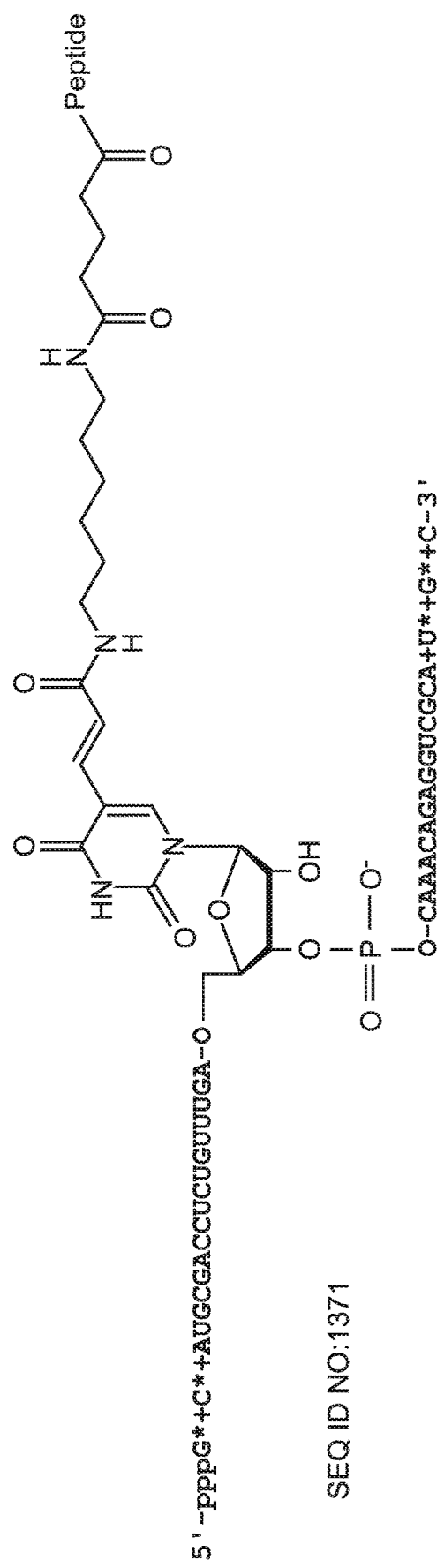
FIG. 79 illustrates a peptide-I/O complex of the present disclosure comprising a peptide of SEQ ID NO: 569 and an I/O of SEQ ID NO: 1371 with phosphorothioate linkages and BNA/LNA as denoted respectively by an asterix (*) and plus symbol (+) respectively) linked by a stable linker, where the linker is attached to a modified base in the dsRNA used as a conjugation or linkage site (e.g., as shown in the figure, a uridine in SEQ ID NO:1371 is modified to be uridine with an extended amine attached to the linker, and the linker is also attached to the peptide (as denoted)). The dsRNA of SEQ ID NO: 1371 in this peptide-I/O complex has a 5'ppp (triphosphate) and is formed as a hairpin structure.

Large-scale purification of SEQ ID NO: 1317 and SEQ ID NO: 1321 using 20 mL of starting material (10×) was performed on the same size columns (1 mL) used for the small-scale purification. FIG. 53 illustrates Coomassie-stained SDS-PAGE of fractions obtained from the large-scale purification of SEQ ID NO: 1317 and SEQ ID NO: 1321. For both peptide-IL-15 agent complexes, high concentrations of purified protein eluted in fractions E2-E4. The lack of any prominent bands seen at 38 kD in the flow-through (FT) fraction of each purification run indicated the column was not overloaded and has a high binding capacity for these proteins. FIG. 54 illustrates Coomassie-stained SDS-PAGE of fractions E2-E4, which were pooled, buffer exchanged in PBS, and further analyzed under reducing and non-reducing conditions. A single prominent band at ~38 kD seen under non-reducing conditions suggests the proteins are homogenous with no scrambling of disulfide linkages that may produce intermolecular disulfides resulting in disulfide-linked aggregates.

Other RLI can be similarly purified, such as peptide-IL-15 agent complexes containing an IL-15 agent such as $L_0$-X-$L_1$-Y-$L_2$, wherein $L_1$ can be SEQ ID NO: 1169 or SEQ ID NO: 1163, X can be SEQ ID NO: 1176 or SEQ ID NO: 1179, and Y can be SEQ ID NO: 1177, SEQ ID NO: 1178, in any combination. In addition, peptide-IL-15 agent complexes can comprise any of the complexes of TABLE 4.

Example 44

Screening of Peptide-Immuno-oncology Agent (I/Os) Complexes

This example describes screening of I/Os to be administered as a complex with a peptide of the present disclosure for cancer therapy. A peptide of the present disclosure, such as any peptide of SEQ ID NO: 1-SEQ ID NO: 1134, SEQ ID NO: 1243-SEQ ID NO: 1262, or SEQ ID NO: 1263-SEQ ID NO: 1316, is recombinantly expressed or chemically synthesized and complexed with an I/O. The I/O is an IL-15 agent, a 4-1BB ligand, a RIG-I ligand, an MDA5 ligand, or a STING ligand or any one of the exemplary I/Os of the present application, such as cytokines, including, but not limited to, interferons, interleukin (IL)-2, IL-15, IL-21, IL-12, IL-23, IL-27, IL-1, IL-18, IL-33; checkpoint inhibitors including, but not limited to, inhibitors of CTLA-4, PD-1, TIM-3, LAG-3, VISTA, B7-H3, B7-H4, B7S1, galectin 9, CD244, BTLA, CD160, CIS, LIGHT, TIGIT; ligands of pattern recognition receptors (PRRs) including, but not limited to TLR, NLR, ALR, CLR, RLR, RIG-I, and STING; molecules that inhibit the macrophage checkpoint CD47, including, but not limited to, SIRPα, which can downregulate CD47 expression at the cell surface of cancer cells or can directly block the CD47-SIRPα interaction; molecules that inhibit the activity of the enzyme indoleamine-2,3-dioxygenase (IDO); molecules that block natural killer (NK) cell checkpoints including, but not limited to, KIR2DL1-3, KIR3DL1, and CD94/NKG2A; and ligands or other agonists of TNF family members including, but not limited to, CD40, 4-1BB, OX40, ICOS, CD27, TL-1A, TRAIL, FAS, and GITR. Complexes are formed by chemical conjugation with a cleavable or stable linker, recombinant expression as a fusion with a cleavable or stable linker, co-formulation in a liposome, or complexes of a peptide with an expression vector encoding for the I/O formulated in a liposome.

Initial in vitro screening is carried out to assess how efficiently a peptide is able to deliver an I/O to the appropriate compartment (i.e., extracellular for IL-15 agents and 4-1BB ligands and intracellular for RIG-I ligands and STING ligands) as compared to free I/O. Subsequent in vivo screening is carried out to identify a lead I/O. Peptide-I/O complexes are compared in vivo to the peptide alone, empty liposomes, and free I/O. In vitro and in vivo results are analyzed to identify peptide-I/O complexes, which induce the greatest tumor regression as opposed to free I/O.

Example 45

In Vivo Tumor Activity

This example describes the experimental design to show that a peptide-I/O complex of the present disclosure will effectively treat an established tumor in a mouse. A tumor cell line is implanted, in one of various tissues, including subcutaneous, intravenous (metastasis), or orthotopic. The tumor is allowed time to establish, for example, a few days or weeks. The mouse is treated with the drug by one of various routes of administration, for example, intravenous, subcutaneous, intratumoral, or intraperitoneal. The drug is administered once or several times over the period of the experiment. The size of the tumor is monitored until untreated mice are terminated due to tumor growth. When available, mice with targeted gene deletions or knockouts are used to verify a mechanism of action. Alternatively, tumors with gene knockouts are also used. Pharmacodynamic biomarkers are used to measure I/O-related biological effects and to further indicate a mechanism of I/O action. Mice administered peptide-I/O complexes are compared to free I/O to assess the enhancement in efficacy obtained by complexing the I/O with a peptide of the present disclosure.

For example, the therapeutic model 4T1 is an aggressive mammary tumor of the mouse (Oh et al., Oncotarget. 2017 Jan. 17; 8(3):4730-4746, Chandra et al., Cancer Immunol Res. 2014 September; 2(9):901-10, Calderon et al., Bioconjug Chem. 2017 Feb. 15; 28(2):461-470, Kim et al., Oncotarget. 2016 Mar. 29; 7(13):16130-45). It is implanted orthotopically in the mammary fat pad where it grows and metastasizes. Mice are rested until the tumor reaches a palpable size (50-100 mm$^3$), usually about 7d post implantation. The mice are randomly assigned to the treated or untreated groups. The treatment group gets I/O or peptide-I/O complexes on each of three days, for example day 0, 7, and 14. Treatments can also be administered more frequently, for example every 2 days, 3 times per week, 4 times per week, or daily, until a certain experimental day or until mice are euthanized. Tumor growth is monitored, for example, daily, and mice are euthanized as the tumor reaches 1000 mm$^3$. Prior to study termination, lymphoid tissues (spleen and lymph nodes) are harvested from mice of each group, and analyzed for immune responses against the tumor, by stimulating those cells in vitro with irradiated or mitomycin C treated 4T1 cells. The cultured cells are assayed after 18-24 hours for production of key mediators such as chemokines and cytokines, using multiplex assays. Tumors and draining lymph nodes are further evaluated for the presence of immune cells such as CD4 and CD8 T cells, DCs, NKs, B cells, Tregs, memory T cells, and myeloid suppressor cells. Expression of activation markers, such as CD69, CD80, and CD86, is measured on the immune cells. The expression of secreted cytokines in these cells is measured by intracellular staining with antibodies to the cytokines. Anti-tumor immune responses are measured in vitro by the secretion of cytokines in response of lymphocytes to the tumor cells, or to known antigenic peptides. Serum cytokine levels are measured to assess systemic immune activation. Circulating anti-tumor antibodies are measured. Immunohistochemistry of the tumor is used to evaluate infiltrating immune cells as well as the expression of relevant proteins in the tumor. The tumor tissue is also evaluated for the presence of the I/O or the peptide-I/O complex. In addition to growth of the primary tumor, 4T1 is a metastatic tumor. Metastases are counted in the draining lung, lymph nodes, liver and spleen. Reduction in the number and/or size of metastases indicates that the peptide-I/O complex has induced systemic immunity to the tumor. Treatment with some peptide-I/O complexes will act directly on the tumor cell to induce apoptosis. This can be measured in vitro by immunocytochemistry by evaluating the expression of key apoptosis mediators such as the Tunel assay, or detection of caspases 3, 8, and 9. In one version of the 4T1 model, (Wu et al., R Soc Open Sci. 2017 Oct. 25; 4(10):170822), the tumor cells have been engineered to express GFP and luciferase. This allows the detection of tumor cells circulating in the blood, and the measurement of tumors by whole body imaging.

The same methods described for the 4T1 mammary tumor model above are also used for other tumor models, for example, the Colon tumor models CT26 (Kim et al, Oncotarget. 2016 Mar. 29; 7(13):16130-45) and MC38 (Fallon et al. Oncotarget. 2017 Mar. 28; 8(13):20558-20571), pancreatic tumor models MIAPaCa-2, and PANC-1 (Duewell et al., Oncoimmunology. 2015 Apr. 14; 4(10):e1029698) and PANC-02 (Duewell et al., Cell Death Differ. 2014 December; 21(12):1825-37), the melanoma model B16F10 (Kubo et al., Cancer Immunol Res. 2017 September; 5(9):812-820, Demaria et al., Proc Natl Acad Sci USA. 2015 Dec. 15; 112(50):15408-13), the prostate tumor model TRAMP-C2 (Fu et al., Sci Transl Med. 2015 Apr. 15; 7(283):283ra52), the bladder tumor model MB49 (Fallon et al. Oncotarget. 2017 Mar. 28; 8(13):20558-20571), myeloma models MOPC-315 and 5T33P (Xu et al., Cancer Res. 2013 May 15; 73(10):3075-86), AML model C1498 (Curran et al., Cell Rep. 2016 Jun. 14; 15(11):2357-66), the mammary tumor model TSA, and the mouse lung cancer models LLC and TC-1 (Yang 2016). These subcutaneous tumor models are useful to study abscopal effects, using bilateral tumors, only one of which receives intratumoral treatment. Treatment effects on the contralateral tumor reflect the induction of antitumor immunity. Induction of anti-tumor immunity can also be confirmed in mice that have survived tumor implantation by re-challenge of the surviving mice with tumor and showing survival without any retreatment (Xu et al., Cancer Res. 2013 May 15; 73(10):3075-86, Curran et al., Cell Rep. 2016 Jun. 14; 15(11):2357-66). B16F10 also provides a metastatic model, in which tumor cells are injected IV and metastatic lesions are counted in the lungs (Demaria et al., Proc Natl Acad Sci USA. 2015 Dec. 15; 112(50):15408-13). Reduction in the number and/or size of metastases indicates that the peptide-I/O complex has induced systemic immunity to the tumor. Human tumor xenografts can be grown in scid mice, such as the human B cell lymphoma Daudi (Liu et al., J Biol Chem. 2016 Nov. 11; 291(46):23869-23881) and the human prostate tumor PC3 (Liu et al., J Control Release. 2016 Oct. 10; 239:223-30). I/Os that stimulate NK cells or other innate immune mechanisms are also tested in this model.

In some instances, the peptide-I/O complex can be administered to a subject with a primary tumor for which surgical resection is planned. The subject can be a human or non-human animal. Following a sufficient period for an immune response to develop, the primary tumor is excised. The subject is monitored for local or distant recurrence.

Example 46

Combination Treatment with a Peptide-I/O Complex

This example describes combination treatment with a peptide-I/O complex. A peptide-I/O complex of the present disclosure is given to a subject in combination with another therapeutic to achieve improved efficacy compared to administration of either the peptide-I/O complex or the other therapeutic alone. The other therapeutic is a checkpoint inhibitor such as anti-PD1, anti-PDL1 or anti-CTLA4, anti-CD40, IL-12, a therapeutic antibody such as cetuximab, rituximab, or trastuzumab, a cancer vaccine, GM-CSF, a chemotherapeutic such as 5-fluorouracil or cyclophosphamide, radiation therapy, or other cancer therapeutic. Improved efficacy of combination therapy is demonstrated by comparing individual treatments with the combination treatment in vitro and in vivo, as described in EXAMPLE 38 and EXAMPLE 45.

Example 47

Prophylactic Tumor Models

This example describes prophylactic tumor models for assessing immunogenic cell death (ICD) inducing I/Os. The model can, optionally, be tested using B16F10 cells as a melanoma model. Anti-tumor immune responses are examined by prophylactic treatment of mice with ICD-inducing I/O treated tumor cells. I/Os that induce apoptosis of tumor cells can lead to ICD, in which tumor cells can release signals such as reactive oxygen species (ROS), calreticulin and HMGB1, and is dependent on caspase activity, and tumor antigens, which recruit and active dendritic cells. Mature dendritic cells go on to stimulate T cells and, thereby, facilitate anti-tumor immune responses.

Tumor cells are treated in vitro with any I/O of the present disclosure (e.g., RIG-I ligand or a STING ligand each of which acting as an agonist, as described in EXAMPLE 38 and EXAMPLE 39) and treated cells are administered to a subject. The subject is a mouse. Days or weeks post-administration, live tumor cells are administered to mice. Alternatively, live tumor cells are administered simultaneously with administration of treated cells. Treated tumor cells begin undergoing ICD, which is induced by the I/O. The induced ICD facilitates mounting of a potent anti-tumor immune responses in mice. The existence and specificity of anti-tumor immunity is evaluated by challenging surviving mice with the same tumor cells or different tumor cells. Several tumors have been used to successfully investigate ICD, including CT26, Panc-02, and TC-1 and EL4.

Example 48

Peptide-I/O Complex Homing to a Tumor

This example illustrates peptide-I/O complex homing to tumors in humans or animals with cancer. A peptide-I/O complex of the present disclosure is expressed recombinantly or chemically synthesized and is used directly, after radiolabeling, or after conjugation to a fluorophore. A peptide is selected from any one of the peptides of SEQ ID NO: 1-SEQ ID NO: 1134, SEQ ID NO: 1243-SEQ ID NO: 1262, or SEQ ID NO: 1263-SEQ ID NO: 1316. The peptide-I/O complex is administered to a human or animal subcutaneously, intravenously, intratumorally, intramuscularly, intraperitoneally, intradermally, or orally. The peptide-I/O complex homes to the tumor, accumulates in the tumor, is retained by the tumor, is processed by the tumor or its microenvironment, is present in the tumor at higher levels or longer than the I/O alone, or is otherwise preferentially located in the tumor.

Example 49

Intracellular Penetration of a Peptide-I/O Complex

This example illustrates intracellular penetration of a peptide-I/O complex in humans or animals with cancer. A peptide-I/O complex of the present disclosure is expressed recombinantly or chemically synthesized and is used directly, after radiolabeling, or after conjugation to a fluorophore. A peptide is selected from any one of the peptides of SEQ ID NO: 1-SEQ ID NO: 1134, SEQ ID NO: 1243-SEQ ID NO: 1262, or SEQ ID NO: 1263-SEQ ID NO: 1316. The peptide-I/O complex is administered to a human or animal subcutaneously, intravenously, intratumorally, intramuscularly, intraperitoneally, intradermally, or orally. The peptide-I/O complex penetrates the cell membrane to access intracellular compartments at higher levels or longer than the I/O alone.

Example 50

Peptide-I/O Complex Homing to Tumor in Non-Human Animals

This example illustrates a peptide-I/O complex of this disclosure homing to tumors in non-human animals. Non-human animals include but are not limited to guinea pigs, rabbits, dog, cats, horses, rats, mice, cows, pigs, non-human primates, and other non-human animals. A peptide-I/O complex of the present disclosure is expressed recombinantly or chemically synthesized and is used directly, after radiolabeling, or after conjugation to a fluorophore. The peptide is selected from any one of the peptides SEQ ID NO: 1-SEQ ID NO: 1134, SEQ ID NO: 1243-SEQ ID NO: 1262, or SEQ ID NO: 1263-SEQ ID NO: 1316. The resulting peptide-I/O complex is administered to a non-human animal subcutaneously, intravenously, or orally, or is injected directly into a tumor. Biodistribution is assessed by LC/MS, autoradiography, positron emission tomography (PET), scintillation counting, immunohistochemistry, or fluorescence imaging. A peptide-I/O complex is homed to tumors, accumulates in the tumor, is retained by the tumor, is processed by the tumor or its microenvironment, is present in the tumor at higher levels or longer than the I/O alone, or is otherwise preferentially located in the tumor in non-human animals.

Example 51

Peptide-I/O Complex Crossing the Blood Brain Barrier and Homing to the Brain

This example shows the peptide-I/O complex crossing the blood brain barrier (BBB) and/or the blood cerebral spinal fluid (CSF) barrier, and in some cases homing to tumors within the central nervous system (CNS). A peptide-I/O complex of the present disclosure is expressed recombinantly or chemically synthesized and is used directly, after radiolabeling, or after conjugation to a fluorophore and dosed in an animal. At the end of the dosing period, mice are frozen in a hexane/dry ice bath and then frozen in a block of carboxymethylcellulose. Thin, frozen sections of whole animal sagittal slices that include the brain, tumor, liver, kidney, lung, heart, spleen, pancreas, muscle, adipose, gall bladder, upper gastrointestinal tract, lower gastrointestinal tract, bone, bone marrow, reproductive track, eye, cartilage, stomach, skin, spinal cord, bladder, salivary gland, and other types of tissues are obtained with a microtome, allowed to desiccate in a freezer, and exposed to phosphoimager plates for about ten days.

These plates are developed, and the signal (such as radioactivity or fluorescence) from each organ is normalized to the signal found in the heart blood or other tissue of each animal. A signal in tissue darker than the signal expected from blood in that tissue indicates accumulation in a region, tissue, structure or cell.

Example 52

Whole Body Autoradiography of Homing Peptides

This example illustrates whole body autoradiography of peptide homers of this disclosure. Peptides are radiolabeled by methylating lysines at the N-terminus as described in EXAMPLE 3. As such, the peptide can contain methyl or dimethyl lysines and a methylated or dimethlyated amino terminus. A dose of 100 nmol radiolabeled peptide is administered via tail vein injection in Female Harlan athymic nude mice, weighing 20-25 g. The experiment is done in at least duplicate (n=2 animals per group). In some animals, kidneys are ligated to prevent renal filtration of the radiolabeled peptides and extend plasma half-life. Each radiolabeled peptide is allowed to freely circulate within the animal for the described time period before the animals were euthanized and sectioned.

Whole body autoradiography (WBA) sagittal sectioning is performed as follows. At the end of the dosing period, mice are frozen in a hexane/dry ice bath and then embedded in a frozen block of carboxymethylcellulose. Whole animal sagittal slices are prepared that resulted in thin frozen sections for imaging. Thin frozen sections are obtained using a microtome and allowed visualization of tissues such as brain, tumor, liver, kidney, lung, heart, spleen, pancreas, muscle, adipose, gall bladder, upper gastrointestinal tract, lower gastrointestinal tract, bone, bone marrow, reproductive tract, eye, cartilage, stomach, skin, spinal cord, bladder, salivary gland, and more. Sections are allowed to desiccate in a freezer prior to imaging.

For the autoradiography imaging, tape mounted thin sections are freeze dried and radioactive samples were exposed to phosphorimager plates for 7 days. These plates are developed and the signal (densitometry) from each organ was normalized to the signal found in the cardiac blood of each animal. A signal in tissue darker than the signal expected from blood in that tissue indicates accumulation in a region, tissue, structure, or cell.

Example 53

Peptide-I/O Complex Localization in Tumors

This example illustrates binding of peptide-I/O complexes of this disclosure to cells within tumors in animals with intact kidneys. In one embodiment, animals are dosed and are processed as described in EXAMPLE 6 and EXAMPLE 7. At the end of the dosing period, animals are euthanized and the tumor is optionally removed for use in staining and imaging procedures. Whole animal sagittal slices are prepared that result in thin frozen sections being available for staining and imaging. A peptide-I/O complex of this disclosure is found to localize to the tumor microenvironment, localized intracellularly by tumor cells or extracellularly bound or both. Localization is visualized and confirmed by microscopy. Optionally, a peptide-I/O complex of this disclosure is found to penetrate the tumor.

In another embodiment, peptide-I/O complexes of this disclosure are administered in humans and are localized on or in tumor cells.

Example 54

Peptide-Fc Protein Fusions

This example illustrates making and using peptide-I/O complexes as fusions with Fc protein. A peptide of any one of SEQ ID NO: 1-SEQ ID NO: 1134, SEQ ID NO: 1243-SEQ ID NO: 1262, or SEQ ID NO: 1263-SEQ ID NO: 1316 is recombinantly expressed by fusing at the N-terminus or the C-terminus of the sequence for the human IgG1 Fc protein in HEK293 or CHO cells to yield a sequence of SEQ ID NO: 1230 (METDTLLLWVLLLWVPGSTGXXXXXX-XXXXXXXXXXXXXXXXXXXXXXXXXX XXXX-XXXXXXXXXXXXXXXXXXXXXXXXXXXXXXG-GSGGSDKTHTCPPCPAPELL GGPSVFLFPPKPKD-TLMISRTPEVTCVVVDVSHEDPEVKFNWYVD-GVEVHNAKTKPREE QYNSTYRVVSVLTVLHQDW-LNGKEYKCKVSNKALPAPIEKTISKAKGQPREPQV-YTLPP SRDELTKNQVSLTCLVKGFYPSDIAVEWES-NGQPENNYKTTPPVLDSDGSFFLYSKLTV DKSRWQ-QGNVFSCSVMHEALHNHYTQKSLSLSPGK, where X is any peptide of the present disclosure including any one of SEQ ID NO: 1-SEQ ID NO: 1134, SEQ ID NO: 1243-SEQ ID NO: 1262, or SEQ ID NO: 1263-SEQ ID NO: 1316).

A peptide of any one of SEQ ID NO: 1-SEQ ID NO: 1134, SEQ ID NO: 1243-SEQ ID NO: 1262, or SEQ ID NO: 1263-SEQ ID NO: 1316 is recombinantly expressed by fusing at the N-terminus or the C-terminus of the sequence for the human IgG1 Fc protein in HEK293 or CHO cells to yield a sequence of METDTLLLWVLLLWVPG-STGXXXXXXXXXXXXXXXXXXXXXXXXXXXXXX-XXXXXX XXXXXXXXXXXXXXXXXXXXXXXX-XXXXXXXXEPKSCDKTHTCPPCPAPELLGG PSVF-LFPPKPKDTLMISRTPEVTCVVVDVSHEDPEVKFNW-YVDGVEVHNAKTKPREEQY NSTYRVVSVLTVLHQ-DWLNGKEYKCKVSNKALPAPIEKTISKAKGQPREP-QVYTLPPSR DELTKNQVSLTCLVKGFYPSDIA-VEWESNGQPENNYKTTPPVLDSDGSFFLYSKLTVDK SRWQQGNVFSCSVMHEALHNHYTQKSLSLSPGK (SEQ ID NO: 1493), where X is any peptide of the present disclosure including any one of SEQ ID NO: 1-SEQ ID NO: 1134, SEQ ID NO: 1243-SEQ ID NO: 1262, or SEQ ID NO: 1263-SEQ ID NO: 1316).

A recombinantly expressed peptide fused at the N-terminus or the C-terminus of the sequence for the human IgG1 Fc protein in HEK293 or CHO cells can yield a sequence of

```
                                    (SEQ ID NO: 1494)
METDTLLLWVLLLWVPGSTGGSGVPINVRCRGSRDCLDPCRRA

GMREGRCINSRCHCTPGGSGGSDKTHTCPPCPAPELLGGPSVF

LEPPKPKDTLMISRTPEVTCVVVDVSHEDPEVKENWYVDGVEV

HNAKTKPREEQYNSTYRVVSVLTVLHQDWLNGKEYKCKVSNKA

LPAPIEKTISKAKGQPREPQVYTLPPSRDELTKNQVSLTCLVK

GFYPSDIAVEWESNGQPENNYKTTPPVLDSDGSFFLYSKLTVD

KSRWQQGNVFSCSVMHEALHNHYTQKSLSLSPGK.
```

The sequence of any peptide of this disclosure is expressed as a fusion protein with either murine or human Fc by adding a secretion signal sequence to the N-terminus and an Fc sequence to the C-terminus. This creates a bivalent molecule with improved secretion and/or pharmacokinetic properties. The larger peptide-Fc fusion is expressed in different mammalian or insect cell lines and is useful as a research reagent and a therapeutic.

Any peptide of this disclosure is co-expressed with Fc protein to yield Fc-fusion peptides with longer half-life and improved homing to tumor. In SEQ ID NO: 1230, the secretion signal sequence METDTLLLWVLLLWVPGSTG (SEQ ID NO: 1231) is followed by peptide of any one of SEQ ID NO: 1-SEQ ID NO: 1134, SEQ ID NO: 1243-SEQ ID NO: 1262, or SEQ ID NO: 1263-SEQ ID NO: 1316, and is followed by the sequence for Fc protein. Cleaving can be imprecise, resulting in cleavage at position 20 or position 21 of SEQ ID NO: 1230. The peptide-Fc fusion is then chemically conjugated to or formulated with an I/O of the present disclosure or the peptide-Fc fusion is recombinantly expressed with an I/O of the present disclosure.

Example 55

Peptide Conjugate Cleavage

This example describes preparation of peptide-I/O complexes having tunable cleavage rates. The peptide-I/O complexes are synthesized or expressed with the modification that chemical structures are used to provide steric hindrance to cleavage or an altered local environment at the point of cleavage (for both chemical cleavage such as hydrolysis as well as for enzymatic cleavage). In one exemplary conjugate, the peptide-I/O complex is synthesized with one or more methyl groups in close proximity to the cleavable bond to generate steric hindrance, which causes a decreased rate of cleavage. In another exemplary conjugate, one methyl group is present at the adjacent carbon. In another exemplary conjugate, two methyl groups are present at the adjacent carbon. In another exemplary conjugate, one ethyl group is present at the adjacent carbon. In another exemplary conjugate, two ethyl groups are present at the adjacent carbon. In another exemplary conjugate, a cyclic group is present near the site of cleavage. In another exemplary conjugate, the carbon linker length is increased, increasing the local hydrophobicity and lowering the hydrolysis rate. In another exemplary conjugate, a hydroxyl group is located on the adjacent carbon, increasing the local hydrophilicity and increasing the cleavage rate. The rate of cleavage in these exemplary conjugates is therefore adjusted, preventing premature cleavage and ensuring that the more of peptide-I/O complexes accumulate at the desired site in the body or in the cell prior to releasing the active I/O but that the I/O is also released in the tumor microenvironment in a timely manner.

The resulting peptide-I/O complexes are administered to a human or animal intravenous, subcutaneous, intranasal, oral, intraperitoneal, intramuscular, intradermal, or by intratumoral injection to treat disease.

Example 56

Intra-Tumoral Administration of Peptides and Peptide Conjugates

This example illustrates intra-tumoral administration of peptide-I/O complexes of this disclosure. A peptide of this disclosure is expressed recombinantly or chemically synthesized. In some cases, the peptide is subsequently conjugated to an I/O, is recombinantly expressed with an I/O agent, or is formulated with an I/O. The peptide or peptide conjugate is administered to a subject in need thereof via intra-tumoral administration. The tumor is penetrated by the peptide-I/O complexes due to the small size of the peptide-I/O complexes, and due to binding of tumor components by the peptide-I/O complexes. The peptide-I/O complexes is bound to tumor and the residence time in the tumor is longer due to this binding. Optionally, the injected material is aggregated, is crystallized, or complexes are formed, further extending the depot effect and contributing to longer residence time.

The peptide can be any peptide with the sequence selected from SEQ ID NO: 1-SEQ ID NO: 1134, SEQ ID NO: 1243-SEQ ID NO: 1262, or SEQ ID NO: 1263-SEQ ID NO: 1316. Such peptide-drug conjugates can be made using either a cleavable or stable linker as described herein (e.g., EXAMPLES 8 and 9).

Example 57

Treatment of a Brain Tumor with a Peptide-I/O Complex

This example illustrates treatment of a brain tumor using peptide-I/O complexes of the present disclosure. A peptide of the present disclosure is recombinantly expressed or chemically synthesized and are used directly, after conjugation to an I/O. The peptide-I/O complex is administered in a pharmaceutical composition to a subject as a therapeutic for the brain tumor. One or more peptide-I/O complexes of the present disclosure are administered to a subject. A subject can be a human or an animal. The pharmaceutical composition is administered subcutaneously, intravenously, orally, or injected directly into a tumor. The administered peptide-I/O complexes target brain tumor-affected tissues and cells thereof.

In addition, many chemotherapeutics do not cross the blood-brain barrier. A peptide of the disclosure is expressed recombinantly or chemically synthesized and then is conjugated to an I/O, directly or via a cleavable or stable linker. Coupling of the I/O to any one of the peptides of SEQ ID NO: 1-SEQ ID NO: 1134, SEQ ID NO: 1243-SEQ ID NO: 1262, or SEQ ID NO: 1263-SEQ ID NO: 1316 targets the I/O into the brain and to the tumor. One or more peptide-I/O complexes are administered to a human or animal.

The peptide is any peptide with the sequence selected from SEQ ID NO: 1-SEQ ID NO: 1134, SEQ ID NO: 1243-SEQ ID NO: 1262, or SEQ ID NO: 1263-SEQ ID NO: 1316. Such peptide-drug conjugates can be made using either a cleavable or stable linker as described herein (e.g., EXAMPLES 8 and 9).

Example 58

Treatment of Breast Cancer with a Peptide-I/O Complex

This example illustrates treatment of breast cancer using peptide-I/O complexes of the present disclosure. A peptide of the present disclosure is recombinantly expressed or chemically synthesized and are used directly, after conjugation to an I/O. The peptide-I/O complex is administered in a pharmaceutical composition to a subject as a therapeutic for breast cancer. One or more peptide-I/O complexes of the present disclosure are administered to a subject. A subject can be a human or an animal. The pharmaceutical composition is administered subcutaneously, intravenously, orally, or injected directly into a tumor. The administered peptide-I/O complexes target breast cancer-affected tissues and cells thereof.

The peptide is any peptide with the sequence selected from SEQ ID NO: 1-SEQ ID NO: 1134, SEQ ID NO: 1243-SEQ ID NO: 1262, or SEQ ID NO: 1263-SEQ ID NO: 1316. Such peptide-drug conjugates can be made using either a cleavable or stable linker as described herein (e.g., EXAMPLES 8 and 9).

Example 59

Treatment of Melanoma with a Peptide-I/O Complex

This example illustrates treatment of melanoma using peptide-I/O complexes of the present disclosure. A peptide of the present disclosure is recombinantly expressed or chemically synthesized and are used in a complex with an I/O. The peptide-I/O complex is administered in a pharmaceutical composition to a subject as a therapeutic for melanoma. One or more peptide-I/O complexes of the present disclosure are administered to a subject. A subject can be a human or an animal. The pharmaceutical composition is administered subcutaneously, intravenously, orally, or injected directly into a tumor. The administered peptide-I/O complexes target melanoma-affected tissues and cells thereof.

The peptide is any one of SEQ ID NO: 1-SEQ ID NO: 1134, SEQ ID NO: 1243-SEQ ID NO: 1262, or SEQ ID NO: 1263-SEQ ID NO: 1316. Such peptide-I/O complexes can be made using either a cleavable or stable linker as described herein (e.g., EXAMPLES 8 and 9).

Example 60

Treatment of Sarcoma with a Peptide-I/O Complex

This example illustrates treatment of sarcoma using peptide-I/O complexes of the present disclosure. A peptide of the present disclosure is recombinantly expressed or chemically synthesized and are used directly, after conjugation to an I/O. The peptide-I/O complex is administered in a pharmaceutical composition to a subject as a therapeutic for sarcoma. One or more peptide-I/O complexes of the present disclosure are administered to a subject. A subject can be a human or an animal. The pharmaceutical composition is administered subcutaneously, intravenously, orally, or injected directly into a tumor. The administered peptide-I/O complexes target sarcoma-affected tissues and cells thereof.

The peptide is any peptide with the sequence selected from SEQ ID NO: 1-SEQ ID NO: 1134, SEQ ID NO: 1243-SEQ ID NO: 1262, or SEQ ID NO: 1263-SEQ ID NO: 1316. Such peptide-drug conjugates can be made using either a cleavable or stable linker as described herein (e.g., EXAMPLES 8 and 9).

Example 61

Treatment of a Brain Tumor with a Peptide-I/O Complex

This example describes the treatment of a brain tumor with a peptide-I/O complex. Many chemotherapeutics do not cross the blood-brain barrier. A peptide of the disclosure is expressed recombinantly or chemically synthesized and then is conjugated to an I/O, directly or via a cleavable or stable linker. Coupling of the I/O to any one of the peptides of SEQ ID NO: 1-SEQ ID NO: 1134, SEQ ID NO: 1243-SEQ ID NO: 1262, or SEQ ID NO: 1263-SEQ ID NO: 1316 targets the I/O into the brain and to the tumor. One or more peptide-I/O complexes are administered to a human or animal.

Example 62

Treatment of Ewing's Sarcoma with a Peptide-I/O Complex

This example describes the use of the peptide-I/O complexes described herein to treat Ewing's Sarcoma. A peptide of the disclosure is expressed recombinantly or chemically synthesized and then is conjugated to an I/O, directly or via a cleavable or stable linker. Coupling of the I/O to the peptide of any one of SEQ ID NO: 1-SEQ ID NO: 1134, SEQ ID NO: 1243-SEQ ID NO: 1262, or SEQ ID NO: 1263-SEQ ID NO: 1316 targets the drug to Ewing's Sarcoma. One or more peptide-I/O complexes are administered to a human or animal.

Example 63

Treatment of Glioblastoma with a Peptide-I/O Complex

This example describes the use of the peptide-I/O complexes described herein to treat glioblastoma. A peptide of the disclosure is expressed recombinantly or chemically synthesized and then is conjugated to an I/O, directly or via a cleavable or stable linker. Coupling of the I/O to the peptide of any one of SEQ ID NO: 1-SEQ ID NO: 1134, SEQ ID NO: 1243-SEQ ID NO: 1262, or SEQ ID NO: 1263-SEQ ID NO: 1316 targets the drug to the glioblastoma. One or more peptide-I/O complexes are administered to a human or animal.

Example 64

Treatment of Triple-Negative Breast Cancer with a Peptide-I/O Complex

This example describes the use of the peptide-I/O complexes described herein to treat triple-negative breast cancer. A peptide of the disclosure is expressed recombinantly or chemically synthesized and then is conjugated to an I/O complex, directly or via a cleavable or stable linker. Coupling of the I/O to the peptide of any one of SEQ ID NO: 1-SEQ ID NO: 1134, SEQ ID NO: 1243-SEQ ID NO: 1262, or SEQ ID NO: 1263-SEQ ID NO: 1316 targets the drug to the triple-negative breast cancer. One or more peptide-I/O complexes are administered to a human or animal.

Example 65

Treatment of Non-Brain Cancer with a Mutated Peptide

This example describes peptide-I/O complexes used to treat a non-brain cancer. A peptide of the disclosure is mutated. This mutation prevents the mutated peptide from crossing the blood brain barrier. The mutated peptide expressed recombinantly or chemically synthesized and then is conjugated to an I/O agent, directly or via a cleavable or stable linker. Coupling of the I/O to the mutated peptide of any one of SEQ ID NO: 1-SEQ ID NO: 1134, SEQ ID NO: 1243-SEQ ID NO: 1262, or SEQ ID NO: 1263-SEQ ID NO: 1316 targets the drug to a non-brain cancer. For example, the mutated peptide-I/O complexes are targeted to cancer non-brain cancer. One or more peptide-I/O complexes are administered to a human or animal.

Example 66

Treatment of Head and Neck Cancer with a Peptide-RIG-I Ligand Complex

This example describes treatment of head and neck cancer with any peptide of the present disclosure (e.g., any one of SEQ ID NO: 1-SEQ ID NO: 1134, SEQ ID NO: 1243-SEQ ID NO: 1262, or SEQ ID NO: 1263-SEQ ID NO: 1316) conjugated to an I/O disclosed herein. The I/O is a RIG-I ligand. The peptide is recombinantly expressed or chemically synthesized and is conjugated to the RIG-I ligand as described in EXAMPLE 12, EXAMPLE 13, EXAMPLE 15, EXAMPLE 16, or EXAMPLE 17. The peptide-RIG-I ligand complex is administered to a subject. The subject is a human or an animal and has head and neck cancer. Administration is intravenous, subcutaneous, intranasal, oral, intraperitoneal, intramuscular, intradermal, or by intratumoral injection. Upon administration, the peptide-RIG-I ligand complex is targeted to cancerous tissues and cells thereof. The complex is internalized by cancer cells and results in immunogenic cell death, followed by an immune response that reduces or eradicates the cancer, as described in EXAMPLE 38 and exhibits in vivo responses, as described in EXAMPLE 45.

Example 67

Treatment of Head and Neck Cancer with a Peptide-STING Ligand Complex

This example describes treatment of head and neck cancer with any peptide of the present disclosure (e.g., any one of SEQ ID NO: 1-SEQ ID NO: 1134, SEQ ID NO: 1243-SEQ ID NO: 1262, or SEQ ID NO: 1263-SEQ ID NO: 1316) conjugated to an I/O disclosed herein. The I/O is a STING ligand. The peptide is recombinantly expressed or chemically synthesized and is conjugated to the STING ligand as described in EXAMPLE 12, EXAMPLE 13, EXAMPLE 15, EXAMPLE 16, or EXAMPLE 17. The peptide-STING ligand complex is administered to a subject. The subject is a human or an animal and has head and neck cancer. Administration is intravenous, subcutaneous, intranasal, oral, intraperitoneal, intramuscular, intradermal, or by intratumoral injection. Upon administration, the peptide-STING ligand complex is targeted to cancerous tissues and cells thereof. The complex is internalized by cancer cells and results in immunogenic cell death, followed by an immune response that reduces or eradicates the cancer, as described in EXAMPLE 38 and exhibits in vivo responses, as described in EXAMPLE 45.

Example 68

Treatment of Lung Cancer with a Peptide-RIG-I Ligand Complex

This example describes treatment of lung cancer with any peptide of the present disclosure (e.g., any one of SEQ ID NO: 1-SEQ ID NO: 1134, SEQ ID NO: 1243-SEQ ID NO: 1262, or SEQ ID NO: 1263-SEQ ID NO: 1316) conjugated to an I/O disclosed herein. The I/O is a RIG-I ligand. The peptide is recombinantly expressed or chemically synthesized and is conjugated to the RIG-I ligand as described in EXAMPLE 12, EXAMPLE 13, EXAMPLE 15, EXAMPLE 16, or EXAMPLE 17. The peptide-RIG-I ligand complex is administered to a subject. The subject is a human or an animal and has lung cancer. Administration is intravenous, subcutaneous, intranasal, oral, intraperitoneal, intramuscular, intradermal, or by intratumoral injection. Upon administration, the peptide-RIG-I ligand complex is targeted to cancerous tissues and cells thereof. The complex is internalized by cancer cells and results in immunogenic cell death, followed by an immune response that reduces or eradicates the cancer, as described in EXAMPLE 38 and exhibits in vivo responses, as described in EXAMPLE 45.

Example 69

Treatment of Lung Cancer with a Peptide-STING Ligand Complex

This example describes treatment of lung cancer with any peptide of the present disclosure (e.g., any one of SEQ ID NO: 1-SEQ ID NO: 1134, SEQ ID NO: 1243-SEQ ID NO: 1262, or SEQ ID NO: 1263-SEQ ID NO: 1316) conjugated to an I/O disclosed herein. The I/O is a STING ligand. The peptide is recombinantly expressed or chemically synthesized and is conjugated to the STING ligand as described in EXAMPLE 12, EXAMPLE 13, EXAMPLE 15, EXAMPLE 16, or EXAMPLE 17. The peptide-STING ligand complex is administered to a subject. The subject is a human or an animal and has lung cancer. Administration is intravenous, subcutaneous, intranasal, oral, intraperitoneal, intramuscular, intradermal, or by intratumoral injection. Upon administration, the peptide-STING ligand complex is targeted to cancerous tissues and cells thereof. The complex is internalized by cancer cells and results in immunogenic cell death, followed by an immune response that reduces or eradicates the cancer, as described in EXAMPLE 38 and exhibits in vivo responses, as described in EXAMPLE 45.

Example 70

Treatment of Renal Cell Carcinoma with a Peptide-RIG-I Ligand Complex

This example describes treatment of renal cell carcinoma with any peptide of the present disclosure (e.g., any one of SEQ ID NO: 1-SEQ ID NO: 1134, SEQ ID NO: 1243-SEQ ID NO: 1262, or SEQ ID NO: 1263-SEQ ID NO: 1316) conjugated to an I/O disclosed herein. The I/O is a RIG-I ligand. The peptide is recombinantly expressed or chemically synthesized and is conjugated to the RIG-I ligand as described in EXAMPLE 12, EXAMPLE 13, EXAMPLE 15, EXAMPLE 16, or EXAMPLE 17. The peptide-RIG-I ligand complex is administered to a subject. The subject is a human or an animal and has renal cell carcinoma. Administration is intravenous, subcutaneous, intranasal, oral, intraperitoneal, intramuscular, intradermal, or by intratumoral injection. Upon administration, the peptide-RIG-I ligand complex is targeted to cancerous tissues and cells thereof. The complex is internalized by cancer cells and results in immunogenic cell death, followed by an immune response that reduces or eradicates the cancer, as described in EXAMPLE 38 and exhibits in vivo responses, as described in EXAMPLE 45.

Example 71

Treatment of Renal Cell Carcinoma with a Peptide-STING Ligand Complex

This example describes treatment of renal cell carcinoma with any peptide of the present disclosure (e.g., any one of SEQ ID NO: 1-SEQ ID NO: 1134, SEQ ID NO: 1243-SEQ ID NO: 1262, or SEQ ID NO: 1263-SEQ ID NO: 1316) conjugated to an I/O disclosed herein. The I/O is a STING ligand. The peptide is recombinantly expressed or chemically synthesized and is conjugated to the STING ligand as described in EXAMPLE 12, EXAMPLE 13, EXAMPLE 15, EXAMPLE 16, or EXAMPLE 17. The peptide-STING ligand complex is administered to a subject. The subject is a human or an animal and has renal cell carcinoma. Administration is intravenous, subcutaneous, intranasal, oral, intraperitoneal, intramuscular, intradermal, or by intratumoral injection. Upon administration, the peptide-STING ligand complex is targeted to cancerous tissues and cells thereof. The complex is internalized by cancer cells and results in immunogenic cell death, followed by an immune response that reduces or eradicates the cancer, as described in EXAMPLE 38 and exhibits in vivo responses, as described in EXAMPLE 45.

Example 72

Treatment of Lymphoma with a Peptide-RIG-I Ligand Complex

This example describes treatment of lymphoma with any peptide of the present disclosure (e.g., any one of SEQ ID NO: 1-SEQ ID NO: 1134, SEQ ID NO: 1243-SEQ ID NO: 1262, or SEQ ID NO: 1263-SEQ ID NO: 1316) conjugated to an I/O disclosed herein. The I/O is a RIG-I ligand. The peptide is recombinantly expressed or chemically synthesized and is conjugated to the RIG-I ligand as described in EXAMPLE 12, EXAMPLE 13, EXAMPLE 15, EXAMPLE 16, or EXAMPLE 17. The peptide-RIG-I ligand complex is administered to a subject. The subject is a human or an animal and has lymphoma. Administration is intravenous, subcutaneous, intranasal, oral, intraperitoneal, intramuscular, intradermal, or by intratumoral injection. Upon administration, the peptide-RIG-I ligand complex is targeted to cancerous tissues and cells thereof. The complex is internalized by cancer cells and results in immunogenic cell death, followed by an immune response that reduces or eradicates the cancer, as described in EXAMPLE 38 and exhibits in vivo responses, as described in EXAMPLE 45.

Example 73

Treatment of Lymphoma with a Peptide-STING Ligand Complex

This example describes treatment of lymphoma with any peptide of the present disclosure (e.g., any one of SEQ ID NO: 1-SEQ ID NO: 1134, SEQ ID NO: 1243-SEQ ID NO: 1262, or SEQ ID NO: 1263-SEQ ID NO: 1316) conjugated to an I/O disclosed herein. The I/O is a STING ligand. The peptide is recombinantly expressed or chemically synthesized and is conjugated to the STING ligand as described in EXAMPLE 12, EXAMPLE 13, EXAMPLE 15, EXAMPLE 16, or EXAMPLE 17. The peptide-STING ligand complex is administered to a subject. The subject is a human or an animal and has lymphoma. Administration is intravenous, subcutaneous, intranasal, oral, intraperitoneal, intramuscular, intradermal, or by intratumoral injection. Upon administration, the peptide-STING ligand complex is targeted to cancerous tissues and cells thereof. The complex is internalized by cancer cells and results in immunogenic cell death, followed by an immune response that reduces or eradicates the cancer, as described in EXAMPLE 38 and exhibits in vivo responses, as described in EXAMPLE 45.

Example 74

Treatment of Head and Neck Cancer with a Peptide-IL-15 Agent Complex

This example describes treatment of head and neck cancer with any peptide of the present disclosure (e.g., any one of SEQ ID NO: 1-SEQ ID NO: 1134, SEQ ID NO: 1243-SEQ ID NO: 1262, or SEQ ID NO: 1263-SEQ ID NO: 1316) expressed as a complex with an I/O disclosed herein. The I/O is any IL-15 agent disclosed herein. The peptide is recombinantly expressed as a complex with an IL-15 agent as described in EXAMPLE 18. The peptide-IL-15 agent complex is administered to a subject. The subject is a human or an animal and has head and neck cancer. Administration is intravenous, subcutaneous, intranasal, oral, intraperitoneal, intramuscular, intradermal, or by intratumoral injection. Upon administration, the peptide-IL-15 agent complex is concentrated in the tumor microenvironment. Optionally, the IL-15 agent is cleaved from the peptide in the tumor microenvironment or in the tumor cells. Optionally, the IL-15 agent is processed and displayed on the surface of the tumor cells. The IL-15 agent acts on cells of the immune system to initiate, prolong, and/or enhance an immune response that reduces or eradicates the cancer, as described in EXAMPLE 38 and exhibits in vivo responses, as described in EXAMPLE 45.

Example 75

Treatment of Head and Neck Cancer with a Peptide-4-1BB Ligand Complex

This example describes treatment of head and neck cancer with any peptide of the present disclosure (e.g., any one of SEQ ID NO: 1-SEQ ID NO: 1134, SEQ ID NO: 1243-SEQ ID NO: 1262, or SEQ ID NO: 1263-SEQ ID NO: 1316) expressed as a complex with an I/O disclosed herein. The I/O is a 4-1BB ligand. The peptide is recombinantly expressed as a complex, or a fusion protein, with the 4-1BB ligand as described in EXAMPLE 19. The peptide-4-1BB ligand complex is administered to a subject. The subject is a human or an animal and has head and neck cancer. Administration is intravenous, subcutaneous, intranasal, oral, intraperitoneal, intramuscular, intradermal, or by intratumoral injection. Upon administration, the peptide-4-1BB ligand complex is concentrated in the tumor microenvironment. Optionally, the 4-1BB ligand is cleaved from the peptide in the tumor microenvironment or in the tumor cells. Optionally, the 4-1BB ligand is processed and displayed on the surface of the tumor cells. The 4-1BB ligand acts on cells of the immune system to initiate, prolong, and/or enhance an immune response that reduces or eradicates the cancer, as described in EXAMPLE 38 and exhibits in vivo responses, as described in EXAMPLE 45.

Example 76

Treatment of Lung Cancer with a Peptide-IL-15 Agent Complex

This example describes treatment of lung cancer with any peptide of the present disclosure (e.g., any one of SEQ ID NO: 1-SEQ ID NO: 1134, SEQ ID NO: 1243-SEQ ID NO: 1262, or SEQ ID NO: 1263-SEQ ID NO: 1316) expressed as a complex or fusion with an I/O disclosed herein. The I/O is any IL-15 agent disclosed herein. The peptide is recombinantly expressed as a complex, or fusion protein, with the IL-15 agent as described in EXAMPLE 18. The peptide-IL-15 agent complex is administered to a subject. The subject is a human or an animal and has lung cancer. Administration is intravenous, subcutaneous, intranasal, oral, intraperitoneal, intramuscular, intradermal, or by intratumoral injection. Upon administration, the peptide-IL-15 agent complex is concentrated in the tumor microenvironment. Optionally, the IL-15 agent is cleaved from the peptide in the tumor microenvironment or in the tumor cells. Optionally, the IL-15 agent is processed and displayed on the surface of the tumor cells. The IL-15 agent acts on cells of the immune system to initiate, prolong, and/or enhance an immune response that reduces or eradicates the cancer, as described in EXAMPLE 38 and exhibits in vivo responses, as described in EXAMPLE 45.

Example 77

Treatment of Lung Cancer with a Peptide-4-1BB Ligand Complex

This example describes treatment of lung cancer with any peptide of the present disclosure (e.g., any one of SEQ ID NO: 1-SEQ ID NO: 1134, SEQ ID NO: 1243-SEQ ID NO: 1262, or SEQ ID NO: 1263-SEQ ID NO: 1316) expressed as a fusion with an I/O disclosed herein. The I/O is a 4-1BB ligand. The peptide is recombinantly expressed as a complex, or fusion protein, with the 4-1BB ligand as described in EXAMPLE 19. The peptide-4-1BB ligand complex is administered to a subject. The subject is a human or an animal and has lung cancer. Administration is intravenous, subcutaneous, intranasal, oral, intraperitoneal, intramuscular, intradermal, or by intratumoral injection. Upon administration, the peptide-4-1BB ligand complex is concentrated in the tumor microenvironment. Optionally, the 4-1BB ligand is cleaved from the peptide in the tumor microenvironment or in the tumor cells. Optionally, the 4-1BB ligand is processed and displayed on the surface of the tumor cells. The 4-1BB ligand acts on cells of the immune system to initiate, prolong, and/or enhance an immune response that reduces or eradicates the cancer, as described in EXAMPLE 38 and exhibits in vivo responses, as described in EXAMPLE 45.

Example 78

Treatment of Renal Cell Carcinoma with a Peptide-IL-15 Agent Complex

This example describes treatment of renal cell carcinoma with any peptide of the present disclosure (e.g., any one of SEQ ID NO: 1-SEQ ID NO: 1134, SEQ ID NO: 1243-SEQ ID NO: 1262, or SEQ ID NO: 1263-SEQ ID NO: 1316) expressed as a fusion with an I/O disclosed herein. The I/O is any IL-15 agent disclosed herein. The peptide is recombinantly expressed as a complex, or fusion protein, with the IL-15 agent as described in EXAMPLE 18. The peptide-IL-15 agent complex is administered to a subject. The subject is a human or an animal and has renal cell carcinoma. Administration is intravenous, subcutaneous, intranasal, oral, intraperitoneal, intramuscular, intradermal, or by intratumoral injection. Upon administration, the peptide-IL-15 agent complex is concentrated in the tumor microenvironment. Optionally, the IL-15 agent is cleaved from the peptide in the tumor microenvironment or in the tumor cells. Optionally, the IL-15 agent is processed and displayed on the surface of the tumor cells. The IL-15 agent acts on cells of the immune system to initiate, prolong, and/or enhance an immune response that reduces or eradicates the cancer, as described in EXAMPLE 38 and exhibits in vivo responses, as described in EXAMPLE 45.

Example 79

Treatment of Renal Cell Carcinoma with a Peptide-4-1BB Ligand Complex

This example describes treatment of renal cell carcinoma with any peptide of the present disclosure (e.g., any one of SEQ ID NO: 1-SEQ ID NO: 1134, SEQ ID NO: 1243-SEQ ID NO: 1262, or SEQ ID NO: 1263-SEQ ID NO: 1316) expressed as a fusion with an I/O disclosed herein. The I/O is a 4-1BB ligand. The peptide is recombinantly expressed as a fusion protein with the 4-1BB ligand as described in EXAMPLE 19. The peptide-4-1BB ligand complex is administered to a subject. The subject is a human or an animal and has renal cell carcinoma. Administration is intravenous, subcutaneous, intranasal, oral, intraperitoneal, intramuscular, intradermal, or by intratumoral injection. Upon administration, the peptide-4-1BB ligand complex is concentrated in the tumor microenvironment. Optionally, the 4-1BB ligand is cleaved from the peptide in the tumor microenvironment or in the tumor cells. Optionally, the 4-1BB ligand is processed and displayed on the surface of the tumor cells. The 4-1BB ligand acts on cells of the immune system to initiate, prolong, and/or enhance an immune response that reduces or eradicates the cancer, as described in EXAMPLE 38 and exhibits in vivo responses, as described in EXAMPLE 45.

Example 80

Treatment of Lymphoma with a Peptide-IL-15 Agent Complex

This example describes treatment of lymphoma with any peptide of the present disclosure (e.g., any one of SEQ ID NO: 1-SEQ ID NO: 1134, SEQ ID NO: 1243-SEQ ID NO: 1262, or SEQ ID NO: 1263-SEQ ID NO: 1316) expressed as a complex, or a fusion, with an I/O disclosed herein. The I/O is any IL-15 agent disclosed herein. The peptide is recombinantly expressed as a complex, or a fusion protein, with the IL-15 agent as described in EXAMPLE 18. The peptide-IL-15 agent complex is administered to a subject. The subject is a human or an animal and has lymphoma. Administration is intravenous, subcutaneous, intranasal, oral, intraperitoneal, intramuscular, intradermal, or by intratumoral injection. Upon administration, the peptide-IL-15 agent complex is concentrated in the tumor microenvironment. Optionally, the IL-15 agent is cleaved from the peptide in the tumor microenvironment or in the tumor cells. Optionally, the IL-15 agent is processed and displayed on the surface of the tumor cells. The IL-15 agent acts on cells of the immune system to initiate, prolong, and/or enhance an immune response that reduces or eradicates the cancer, as described in EXAMPLE 38 and exhibits in vivo responses, as described in EXAMPLE 45.

Example 81

Treatment of Lymphoma with a Peptide-4-1BB Ligand Complex

This example describes treatment of lymphoma with any peptide of the present disclosure (e.g., any one of SEQ ID NO: 1-SEQ ID NO: 1134, SEQ ID NO: 1243-SEQ ID NO:

1262, or SEQ ID NO: 1263-SEQ ID NO: 1316) expressed as a complex, or a fusion, with an I/O disclosed herein. The I/O is a 4-1BB ligand. The peptide is recombinantly expressed as a complex, or a fusion protein, with the 4-1BB ligand as described in EXAMPLE 19. The peptide-4-1BB ligand complex is administered to a subject. The subject is a human or an animal and has lymphoma. Administration is intravenous, subcutaneous, intranasal, oral, intraperitoneal, intramuscular, intradermal, or by intratumoral injection. Upon administration, the peptide-4-1BB ligand complex is concentrated in the tumor microenvironment. Optionally, the 4-1BB ligand is cleaved from the peptide in the tumor microenvironment or in the tumor cells. Optionally, the 4-1BB ligand is processed and displayed on the surface of the tumor cells. The 4-1BB ligand acts on cells of the immune system to initiate, prolong, and/or enhance an immune response that reduces or eradicates the cancer, as described in EXAMPLE 38 and exhibits in vivo responses, as described in EXAMPLE 45.

Example 82

Delivery of RIG-I Ligand to the Cytoplasm of SEAP Reporter Cell Line by Peptide Conjugation This example describes delivery of a RIG-I ligand to the cytoplasm of a SEAP reporter cell line by peptide conjugation. A murine B16-Blue IFN-alpha/beta SEAP reporter cell line was used that allows the detection of bioactive murine type I IFNs by monitoring the activation of the JAK/STAT/ISGF3 pathway and/or IRF3 pathway. Stimulation of these cells with a type I IFN inducer (such as RIG-I ligands) intracellularly triggers the production of secreted embryonic alkaline phosphatase (SEAP) by the activation of the IRF-inducible promoter. These cells are derived from the murine B16 melanoma cell line of C57BL/6 origin stably transfected with a SEAP reporter gene under the control of the IFN-α/β-inducible ISG54 promoter enhanced by a multimeric ISRE. Cells were thawed and maintained in RPMI with Heat Inactivated 10% fetal bovine serum, 50 U/ml penicillin, 50 µg/ml streptomycin, 100 µg/ml Normocin™, 2 mM L-glutamine, 100 µg/mL Zeocin. For all assay reads, selective antibiotics were excluded from the complete growth medium. The assay was carried out as follows. B16-Blue reporter cells were plated at 20,000 or 60,000 cells per well in clear 96 well tissue culture plates in 100 µL volume and allowed to attach overnight. The following day, appropriate experiment treatment media was formulated. The RNA-containing test articles, such as double-stranded RNA as well as peptide-I-O complexes, were dissolved in water to form a stock solution. For wells in which transfection was used, Lipofectamine 300 treatments were prepared according to manufacturer's protocol. At time of treatment, appropriate wells were aspirated. Treatment media was then added back to the appropriate corresponding wells at a final volume of 75 or 200 µL. Plates were incubated for the appropriate amount of time (24 hr, 48 hr, or 72 hr). At 24 hr, 48 hr, and 72 hr, cell plate(s) were removed from the incubator and 10 µL was pipetted from experiment and control wells to new white-wall 96 well plate(s) containing 50 µL SEAP assay reagent. This plate was mixed by shaking briefly and allowed to incubate for 15-20 minutes prior to reading on plate reader.

Figure 19:
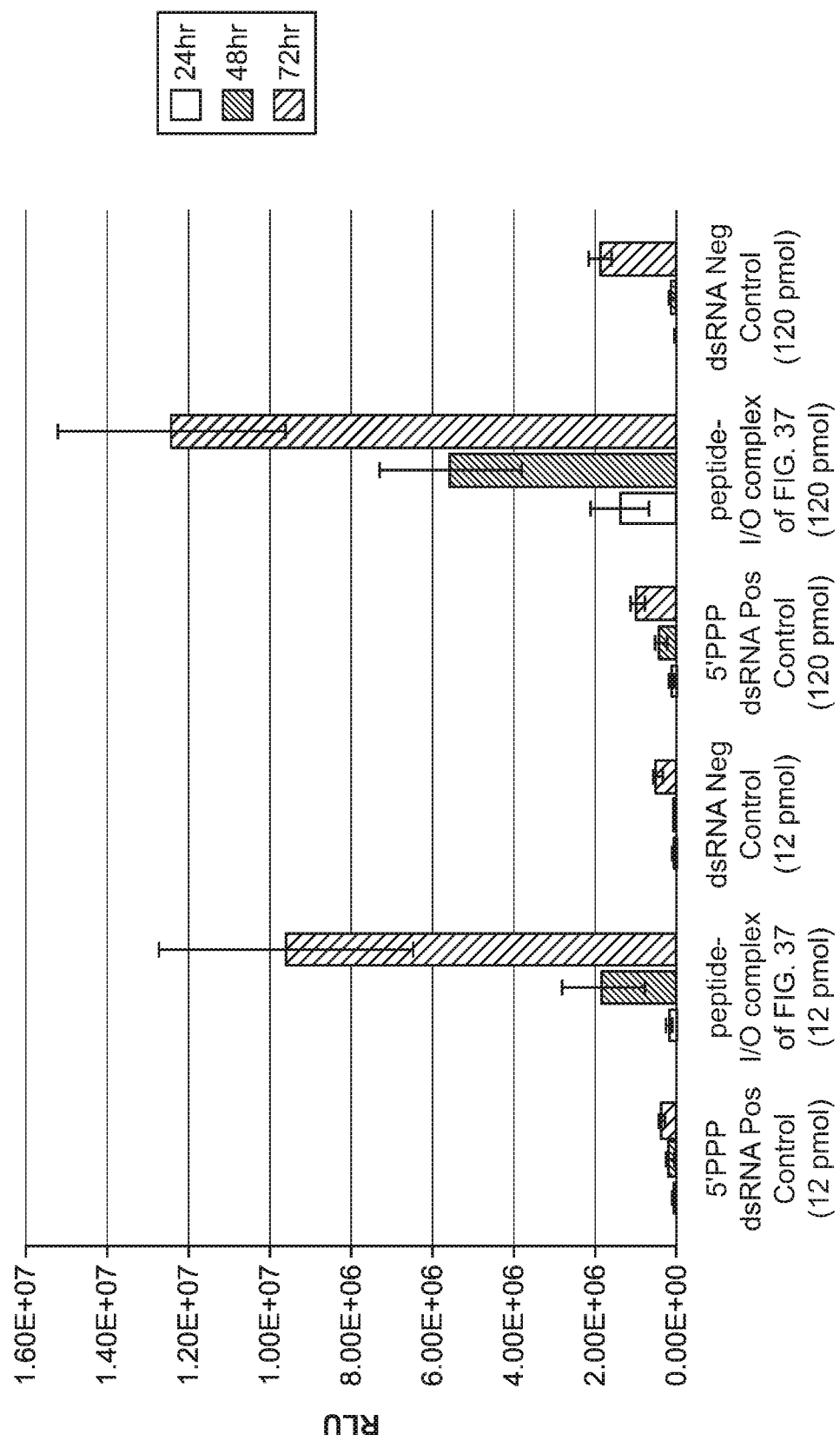
FIG. 19 illustrates the luminescence signal in relative luminescence units (RLUs) from activating the IFN pathway in SEAP reporter cells 24, 48, or 72 hours after treating the cells with 12 pmol or 120 pmol of a peptide-I/O complex of FIG. 37, a 5'ppp dsRNA (denoted as "5'PPP dsRNA Pos Control" in FIG. 19) which is SEQ ID NO: 1424 (with triphosphate on the 5' end) and SEQ ID NO: 1425 (no terminal phosphates) complexed together (the same sequence of 5'ppp RNA as in the peptide-I/O complex of FIG. 37, double-stranded but without the peptide-linker), or a dsRNA (denoted as "dsRNA Neg Control" in FIG. 19) which is SEQ ID NO: 1424 and SEQ ID NO: 1425 (no terminal phosphates on either strand) complexed together (the same sequence of RNA double-stranded as in the peptide-I/O complex of FIG. 37, but without the 5'ppp and without the peptide-linker).
Figure 20:
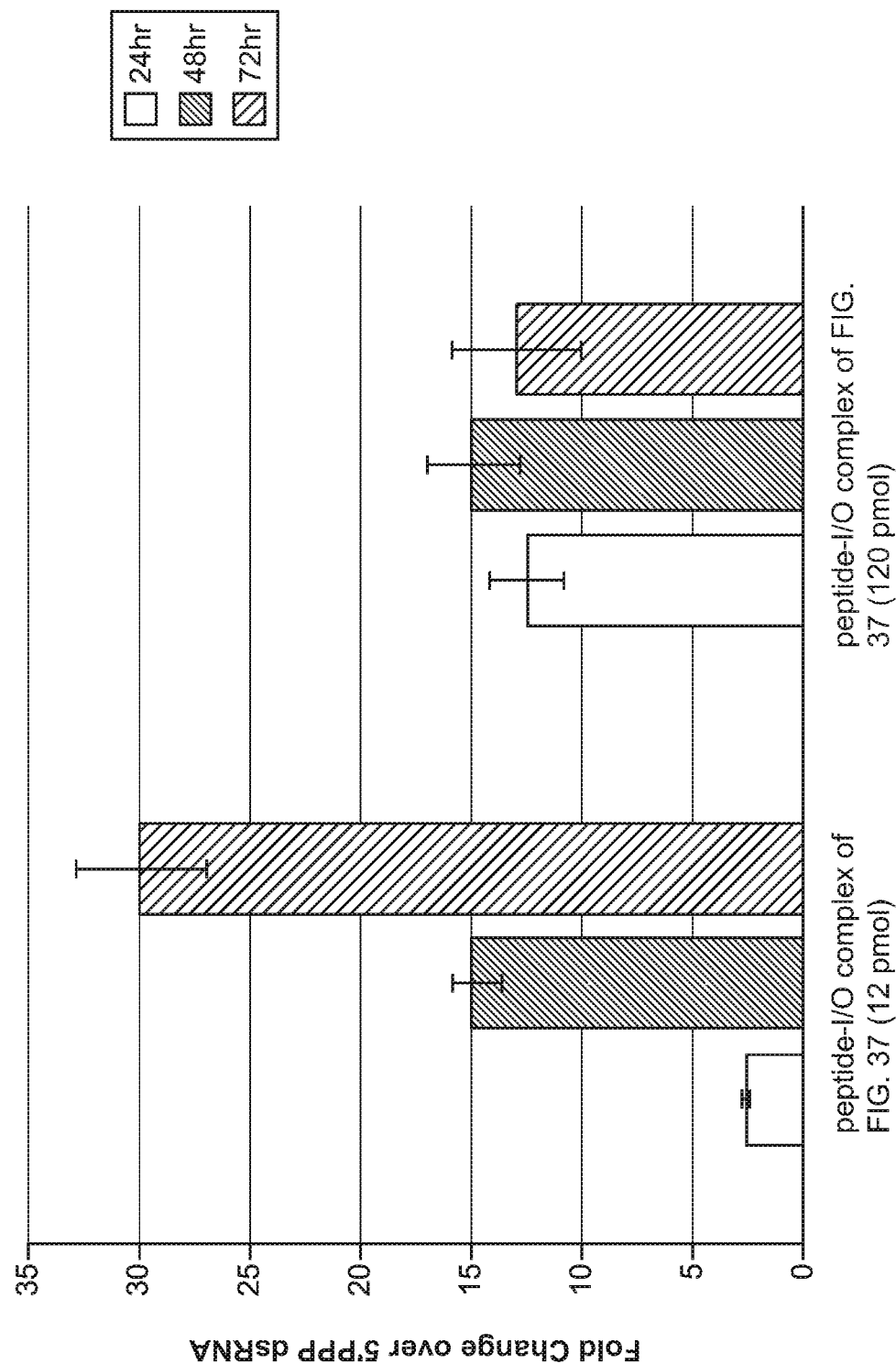
FIG. 20 illustrates fold increase in signal by dosing 12 pmol or 120 pmol of a peptide-I/O complex of FIG. 37 as compared to the 5'ppp dsRNA described in FIG. 19 at 24, 48, and 72 hours post-treatment.
Figure 21:
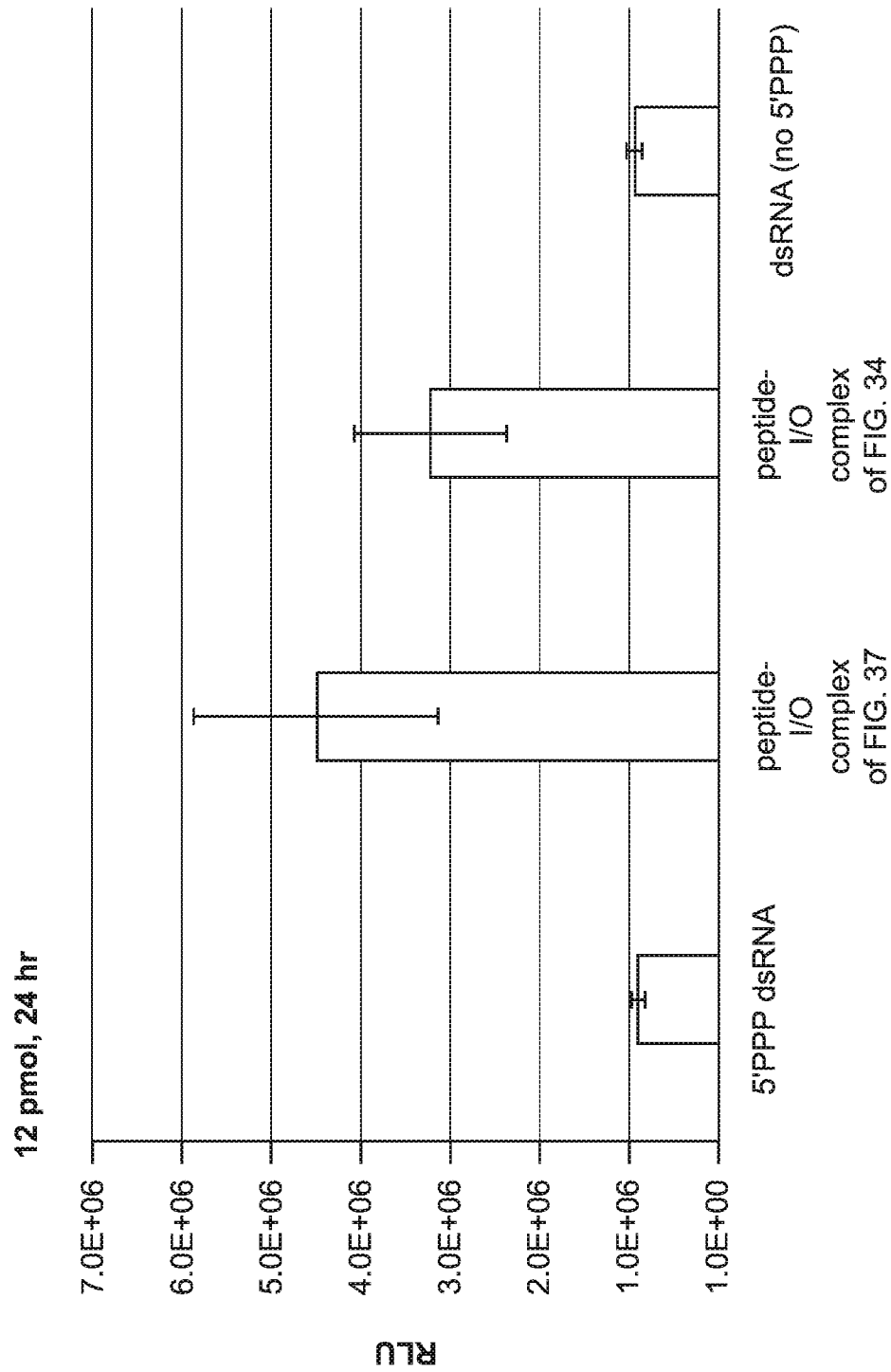
FIG. 21 illustrates the relative luminescence units (RLU) 24 after treating the cells with 12 pmol of a peptide-I/O complex of FIG. 37, a peptide-I/O complex of FIG. 34, 5'ppp dsRNA Pos Control described in FIG. 19 (denoted as "5'PPP dsRNA"), or dsRNA Neg Control described in FIG. 19 (denoted as "dsRNA(no5'PPP)")(the same sequence of RNA double-stranded but without the 5'ppp and without the peptide-linker).
Figure 22:
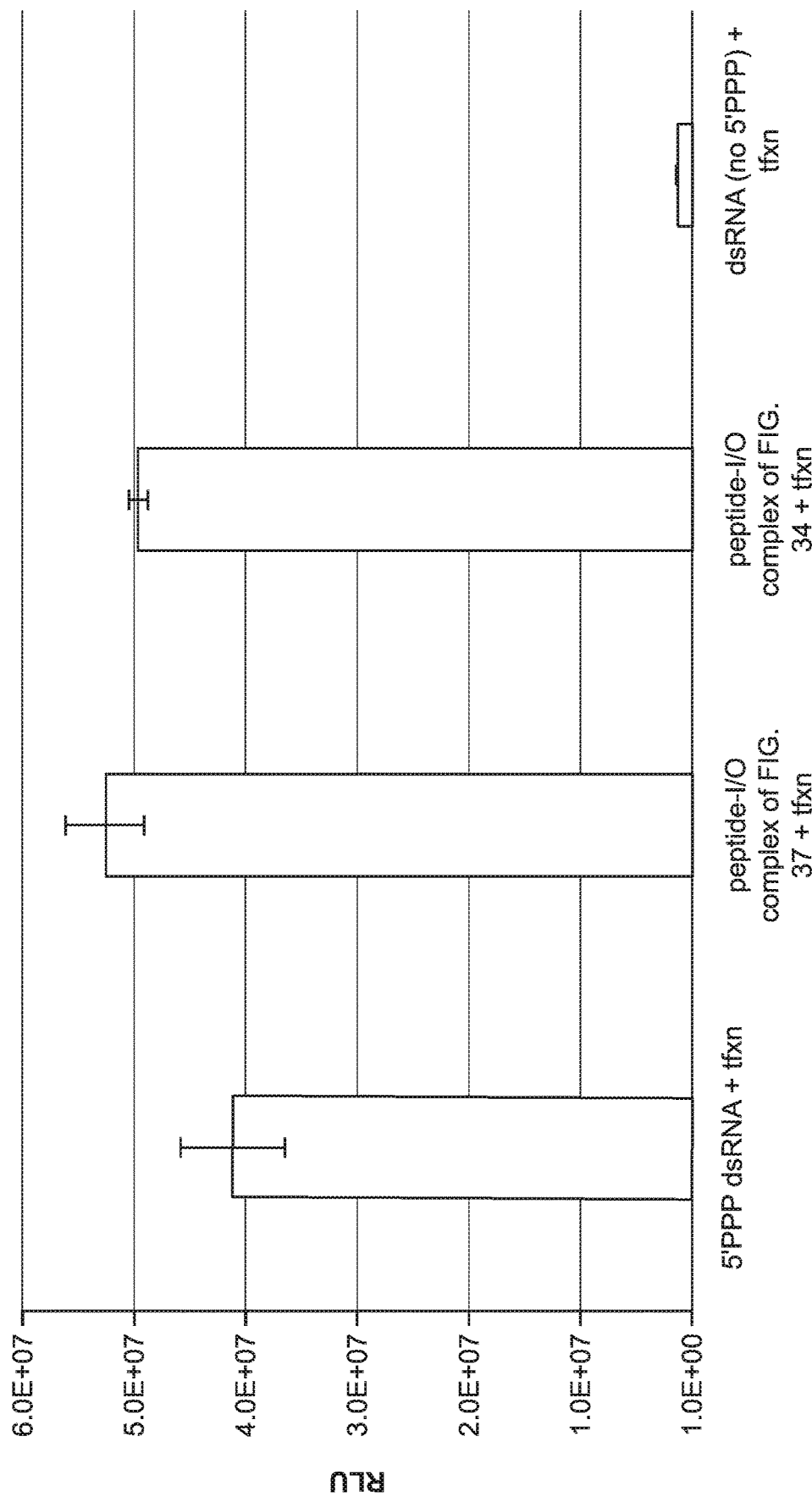
FIG. 22 illustrates RLU signal by dosing 5'ppp dsRNA Pos Control described in FIG. 19 (denoted as "5'PPP dsRNA")+tfxn, the peptide-I/O complex of FIG. 37+tfxn, the peptide-I/O complex of FIG. 34+tfxn, or dsRNA Neg Control described in FIG. 19 (denoted as "dsRNA(no5'PPP)")+tfxn, where Lipofectamine transfection reagent is also added to each test article formulation ("tfxn").
Figure 80:
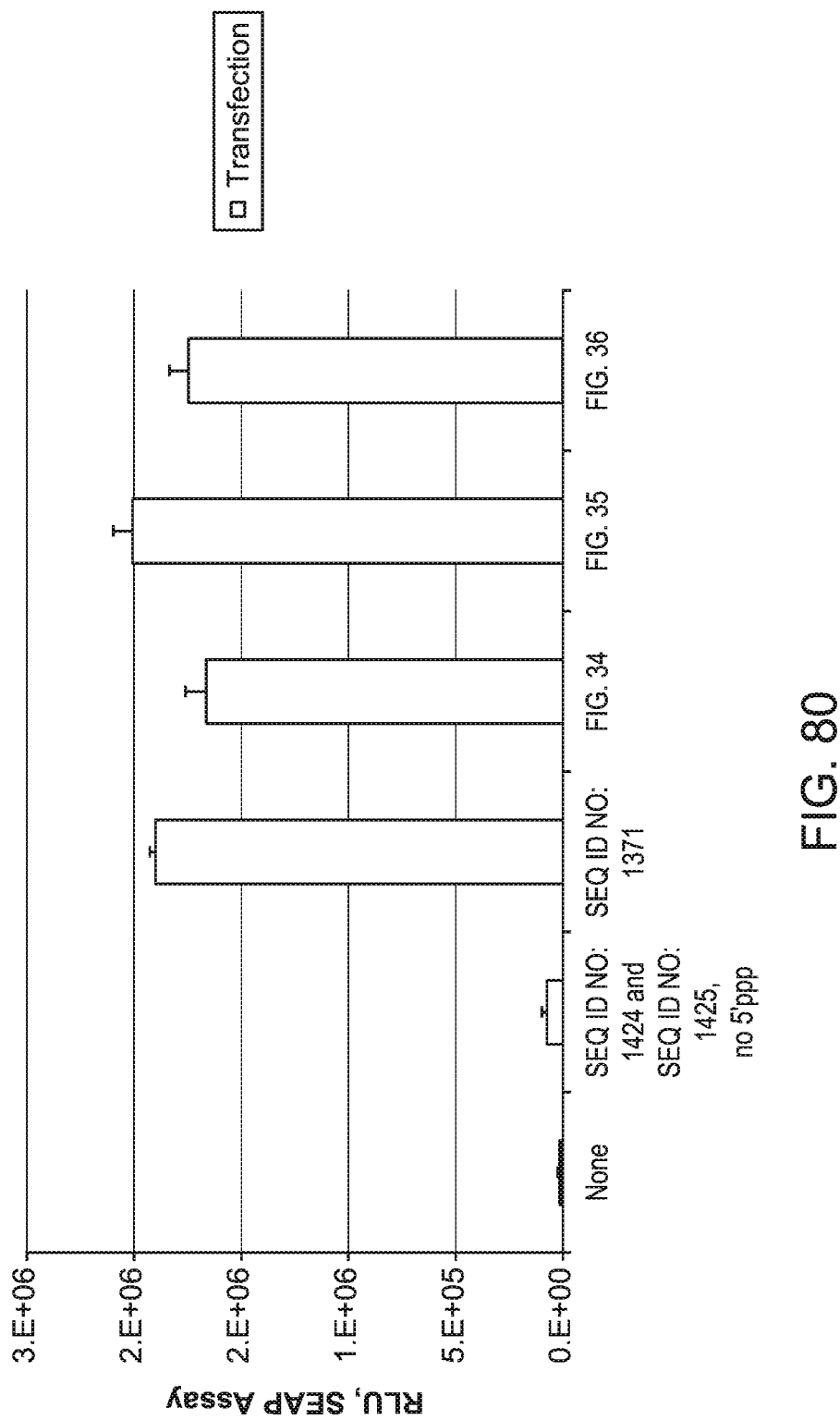
FIG. 80 illustrates the luminescence signal in relative luminescence units (RLUs) from activating the IFN pathway in SEAP reporter cells 24 hours after treating the cells with the transfection reagent Lipofectamine along with 16.2 pmole of each of a peptide-I/O complex of FIG. 34, a peptide-I/O complex of FIG. 36, an I/O of FIG. 35 (a cleavage product of the peptide-I/O of FIG. 34), and I/O of SEQ ID NO: 1371 with 5'ppp (the same sequence of 5'ppp hairpin RNA as in the peptide-I/O complex of FIG. 34 and of FIG. 36 but without modification and linkage to the peptide), or an I/O comprising a dsRNA of two separate RNA strands complexed together comprising SEQ ID NO: 1424 and SEQ ID NO: 1425 (the same sequence of RNA double-stranded as in the peptide-I/O complex of FIG. 34 and of FIG. 36 without the 5'ppp and without modification and linkage to peptide).

FIG. 19 shows the luminescence signal from activating the IFN pathway in the SEAP reporter cells. FIG. 19 shows the relative luminescence units (RLU) 24, 48, or 72 hours after treating the cells with 12 pmol or 120 pmol of a peptide-I/O complex of FIG. 37, 5'ppp dsRNA which is SEQ ID NO: 1424 (with triphosphate on the 5' end) and SEQ ID NO: 1425 (no terminal phosphates) complexed together (the same sequence of 5'ppp RNA as in FIG. 37, double-stranded but without the peptide-linker), or dsRNA which is SEQ ID NO: 1424 and SEQ ID NO: 1425 (no terminal phosphates on either strand) complexed together (the same sequence of RNA as in FIG. 37, double-stranded but without the 5'ppp and without the peptide-linker). No transfection reagent was used in this experiment. It was expected that the presence of a 5'ppp and delivery of the agent to the cytoplasm are both required in order to activate the pathway. This is because a 5'ppp is essential for Rig-I activation and because Rig-I is located into the cytoplasm. It was also expected that 5'ppp dsRNA alone would not reach the cytoplasm at significant levels without addition of a transfection reagent. Very little signal was observed for 5'ppp dsRNA or for dsRNA, whereas significant and increasing signal was seen for a peptide-I/O complex of FIG. 37 at both 12 pmol and 120 pmol doses. This indicated that a peptide-I/O complex of FIG. 37 was able to access the cytoplasm of the cell and activated the RIG-I helicase, without addition of transfection reagent. FIG. 20 shows the fold increase in signal by dosing a peptide-I/O complex of FIG. 37 rather than 5'ppp dsRNA, at matched molar doses of either 12 pmol or 120 pmol. The fold increase by adding the peptide-I/O complex of FIG. 37 ranged from ~3-30× the signal obtained by dosing just 5'ppp dsRNA without the peptide. FIG. 21 shows the relative luminescence units (RLU) 24 hours after treating the cells with 12 pmol of a peptide-I/O complex of FIG. 37, a peptide-I/O complex of FIG. 34, 5'ppp dsRNA Pos Control described in FIG. 19 (denoted as "5'PPP dsRNA"), or dsRNA Neg Control described in FIG. 19 (denoted as "dsRNA(no5'PPP)")(the same sequence of RNA double-stranded but without the 5'ppp and without the peptide-linker)). No transfection reagent was used in this experiment. These results demonstrated that a peptide-I/O complex of FIG. 34 and a peptide-I/O complex of FIG. 37 activated the IFN pathway in the cells at higher levels than 5'ppp dsRNA or dsRNA with no transfection reagent present. FIG. 22 shows the RLU signal obtained by dosing various agents in the presence of transfection reagent. 5'ppp dsRNA with Lipofectamine transfection reagent or dsRNA with Lipofectamine transfection reagent were dosed. Transfection reagents such as Lipofectamine provide a way to deliver a molecule into the cytoplasm in vitro, including those which otherwise would not enter, demonstrating whether something would activate a cytoplasmic target if delivered to the cytoplasm. However, transfection reagents have high toxicity and limited utility in vivo. In FIG. 22, high signaling occurred using transfection reagent with the RNA containing the 5'ppp (confirming the activity of 5'ppp dsRNA if delivered to the cytoplasm, such as with a transfection reagent) as well as using transfection reagent with the peptide I/O complexes of FIG. 34 and of FIG. 37 (confirming the activity of these complexes in the cytoplasm) but much lower signaling occurred with dsRNA (without the 5'ppp) because of the important role of the 5'ppp in activating the RIG-I pathway. In addition, FIG. 80 illustrates the luminescence signal in relative luminescence units (RLUs) from activating the IFN pathway in SEAP reporter cells 24 hours after treating the cells with the transfection reagent Lipofectamine along with either 16.2 pmole of a peptide-I/O complex of FIG. 34, the peptide-I/O complex of FIG. 36, the I/O of FIG. 35, SEQ ID NO: 1371 with 5'ppp (the same sequence of 5'ppp hpRNA but without the peptide-linker), or SEQ ID NO: 1424 and SEQ ID NO:

1425 dsRNA (the same sequence of RNA double-stranded and without the 5'ppp and without the peptide-linker).

High signaling is seen using transfection reagent either with the RNA containing the 5'ppp, with the peptide-I/O complex of FIG. 34, with the cleavage product of the peptide-I/O complex of FIG. 34 (which is the structure of FIG. 35), or with the peptide-I/O complex of FIG. 36. The data of FIG. 22 and FIG. 80 shows that if 5'ppp dsRNA, the peptide-I/O complex of FIG. 34, the peptide-I/O complex of FIG. 37, the peptide-I/O complex of FIG. 36, or the cleavage product of the peptide I/o complex of FIG. 34 (which is the structure shown in FIG. 35) are delivered to the cytoplasm, they can activate the Rig-I pathway.

The combined data also shows the ability of the peptide-I/O complexes such as a peptide-I/O complex of FIG. 37 and a peptide-I/O complex of FIG. 34 to enter the cytoplasm and activate the RIG-I pathway and a type I interferon response.

Example 83

In Vitro Demonstration of Cell Death

This example describes in vitro demonstration of cell death, including apoptosis in cancer cells in vitro, following exposure to a peptide-I/O complex of the present disclosure. The peptide (e.g., any one of SEQ ID NO: 1-SEQ ID NO: 1134, SEQ ID NO: 1243-SEQ ID NO: 1262, or SEQ ID NO: 1263-SEQ ID NO: 1316) is recombinantly expressed or chemically synthesized and then conjugated to a RIG-I ligand or a STING ligand as described in EXAMPLE 12, EXAMPLE 13, EXAMPLE 15, EXAMPLE 16, or EXAMPLE 17 or as given in FIGS. 34-44. A cancer cell line, such as MCF-7 human breast cancer cell line, is grown in culture. Cells are exposed to the peptide-I/O complex. Upon exposure, the peptide-I/O complex is internalized by the cells and some enters the cytoplasm. The I/O stimulates its target (RIG-I, MDA5 or STING), resulting in stimulation of intracellular signaling pathways that lead to cell death, including apoptosis. Induction of cell death is indicated by staining the cells with a monoclonal antibody (mAb) against Annexin V plus propidium iodide (PI) or another fluorescent DNA stain such as 4',6-diamidino-2-phenylindole (DAPI).

Example 84

In Vitro Demonstration of Immune Response to Cancer Cells

This example describes in vitro demonstration of immune response to cancer cells by co-culturing cancer cells treated with a peptide-I/O complex of the present disclosure with isolated immune cells. Immune cells are characterized for proliferation and activation of immune effector and/or memory cell subsets. Cancer cells, such as human cancer cell lines or any of the mouse cancer cell lines used in syngeneic tumor models as described in EXAMPLES 36-, 37, 39, 45, 47, are exposed to a peptide-I/O as described in EXAMPLES 16-19, 43, 54.36, 37, 38. The cells are incubated for a period of time sufficient to develop a response to the peptide-I/O complex, for example, 30 minutes, 1 hour, 4 hours, overnight, 24 hours, or 48 hours. The media is removed and cells are washed to remove any remaining peptide-I/O complex. Control cell cultures are maintained in media without the peptide-I/O complex, but are otherwise treated identically. Meanwhile, immune cells are isolated. When the cancer cells are a human cell line, human PBMC are used as the source of immune cells. When the cancer cells are a mouse cell line, immune cells are isolated from spleens of the syngeneic mouse strain. Isolated immune cells are stained with a CFSE dye such as CellTrace (Invitrogen) and then grown in co-culture with the cancer cells. After incubation for a period of time sufficient to develop a response, for example 30 minutes, 1 hour, 4 hours, overnight, 24 hours, 48 hours, or up to a week, the immune cells are removed from the co-culture. The cells are stained with antibodies to lineage markers, such as CD3, CD4, CD8, CD11 c, and B220, and the proliferation of the marked subsets is analyzed by flow cytometry. Expression of activation markers, such as CD69, CD80, and CD86, on immune subsets is measured by staining with antibodies specific to the lineage marker(s) and activation marker(s) to be evaluated, followed by flow cytometry analysis. The expression of secreted cytokines in these co-cultures is measured by intracellular staining with antibodies to the cytokines, and/or by assays such as ELISA to measure the amount of each protein secreted into the media.

Immune cell responses to peptide-I/O complex treated cancer cells that differs from the response to control cell cultures indicate that the cancer cells have gained or increased immunogenic properties on exposure to the peptide-I/O complex. Immune cell responses include proliferation, upregulation of activation markers, and cytokine expression.

Alternatively, the CFSE-labeled immune cells are cultured with conditioned media harvested from the cancer cell cultures. Assays for lineage-specific proliferation and activation are performed as above. A response indicates that the peptide-I/O complex treated cancer cells secrete soluble factor(s) that stimulate the immune response.

Example 85

In Vitro Demonstration of Immune Cell Chemotaxis and Migration

This example describes co-culture of cancer cells treated with a peptide-I/O complex of the present disclosure with isolated immune cells, in which the immune cells are separated from the cancer cells by a porous membrane or matrix and are characterized for their ability to migrate toward or through the barrier in response to the cancer cells. Cancer cells, such as human cancer cell lines or any of the mouse cancer cell lines used in syngeneic tumor models as described in EXAMPLES 36, 37, and 45, are exposed to a peptide-I/O complex as described in EXAMPLES 36, 37, and 38. The cells are incubated for a period of time sufficient to develop a response to the peptide-I/O complex; for example, 30 minutes, 1 hour, 4 hours, overnight, 24 hours, or 48 hours. The media is removed and cells are washed to remove any remaining peptide-I/O complex. Control cell cultures are maintained in media without the peptide-I/O complex, but are otherwise treated identically. Meanwhile, immune cells are isolated. When the cancer cells are a human cell line, human PBMC are used as the source of immune cells. When the cancer cells are a mouse cell line, immune cells are isolated from spleens of the syngeneic mouse strain. Isolated immune cells are stained with a CFSE dye such as CellTrace (Invitrogen) and then added to a culture chamber adjacent to the cancer cells. After incubation for a period of time sufficient to develop a response, for example 30 minutes, 1 hour, 4 hours, overnight, 24 hours, 48 hours, or up to a week, the chambers are separated and the immune cells are visualized within their original compartment, within the barrier material, and within the cancer cell portion of the chamber. The presence of immune cells within the barrier or the cancer cell chamber in cultures with peptide-I/O complex treated cancer cells to a greater degree than in cultures with control cell cultures indicates that the cancer cells have gained or increased their immune chemotaxis properties on exposure to the peptide-I/O complex.

Example 86

In Vitro Proliferation of Cells Treated with Peptide-IL-15 Agent Complexes

This example describes in vitro proliferation of cells treated with peptide-IL-15 agent complexes using cytokine dependent CTLL2 (mouse cytotoxic T lymphocyte cell line), Mo7e (human acute megakaryoblastic leukemia cell line) and human primary CD8+ T cells. All assays were performed in the 96 well plate format in clear bottom black walled tissue culture plates. Peptide-I/O complexes comprising SEQ ID NO: 568, peptide-I/O complexes comprising an IL-15 agent, and peptide-I/O complexes comprising a His-tagged RLI control proteins (SEQ ID NO: 1342) were diluted in culture media without cytokine supplement. Two, five, and ten fold serial dilutions (concentrations varied by experiment and cell type) were performed and analysis of each molecule was performed in triplicate.

CTLL2 and Mo7e cells were maintained as cell cultures in media containing either IL-2 (CTLL2) or IL-3 (Mo7e). Viability and cell concentration were analyzed using a Viacell cell counter. After counting, the required number of cells was removed from the suspension culture, washed 2-3 times, and resuspended in media that did not contain cytokine supplement and cytokine starved by placing them in a culture flask and incubating at 37° C., 5% $CO_2$ for 4 hours. The cells were then added to the wells (20,000 Mo7e or 5,000 CTLL2 cells in 90 μl) containing 10 μL test proteins and incubated for 2 (CTLL2) or 3 (Mo7e) days (final volume was 100 μL per well). Additional wells that contained growth media without cells were included as a blank for the assay.

CD8+ selected primary human T-cells were received as frozen cells and stored in the LN2 vapor phase until used. Cells were thawed in a 37° C. water bath then slowly added to 5 mL of room temperature 50% FBS/50% RPMI media. 15 mL of room temperature 10% FBS RPMI media was added to the cell suspension; the cells were then pelleted, resuspended in 10% FBS media, and counted using the Viacell. One half of the cells were then appropriately diluted using 10% FBS RPMI media and 40,000 cells/well (in 90 μL) were added to the 96 well plate containing test proteins. Final volume was 100 μL. The second portion of cells were resuspended in media containing 5 μg/mL PHA then incubated at 37° C. for 3 days to generate blasts. The cells were then washed, resuspended in media containing 10 units/mL IL-2, and incubated at 37° C. for 1 day prior to plating as described above.

After the end of the incubation period, PrestoBlue live cell assay reagent (Invitrogen) was added to each well (10 μL per 100 μL well). Plates were then returned to the incubator for 4-6 hours (CTLL2 and Mo7e) or 24 hours (CD8+ cells). Fluorescence was quantified using an Envision (Perkin Elmer 2104) plate reader. Data was graphed and analyzed in Excel, GraphPad Prism 7, or the AAT Bioquest graphing and EC50 calculator https://www.aatbio.com/tools/ec50-calculator.

Figure 28A:
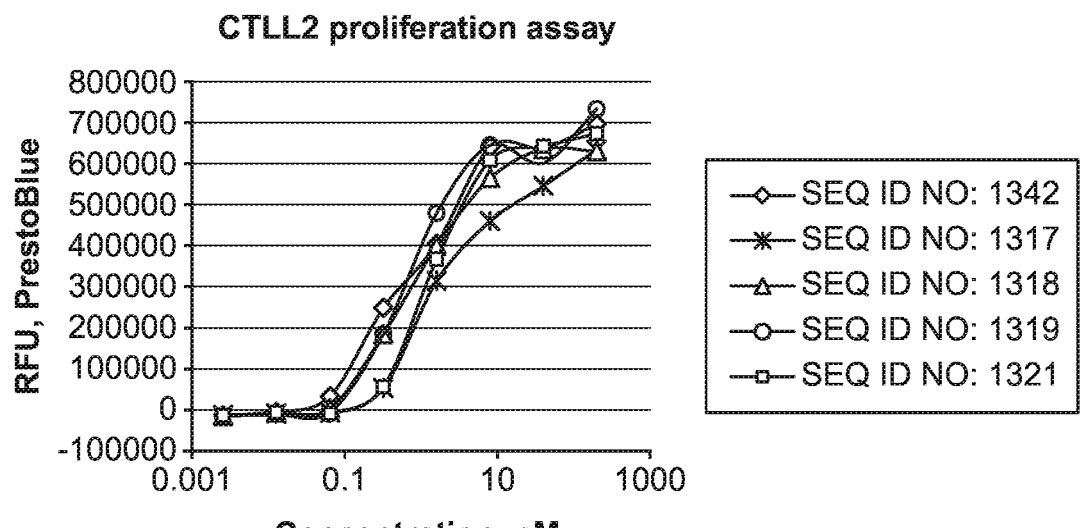
FIG. 28A illustrates proliferation curves for CTLL2 cells after exposure to increasing concentrations of SEQ ID NO: 1317, SEQ ID NO: 1318, SEQ ID NO: 1319, and SEQ ID NO: 1321 and His-tagged RLI protein (SEQ ID NO: 1342).
Figure 28B:
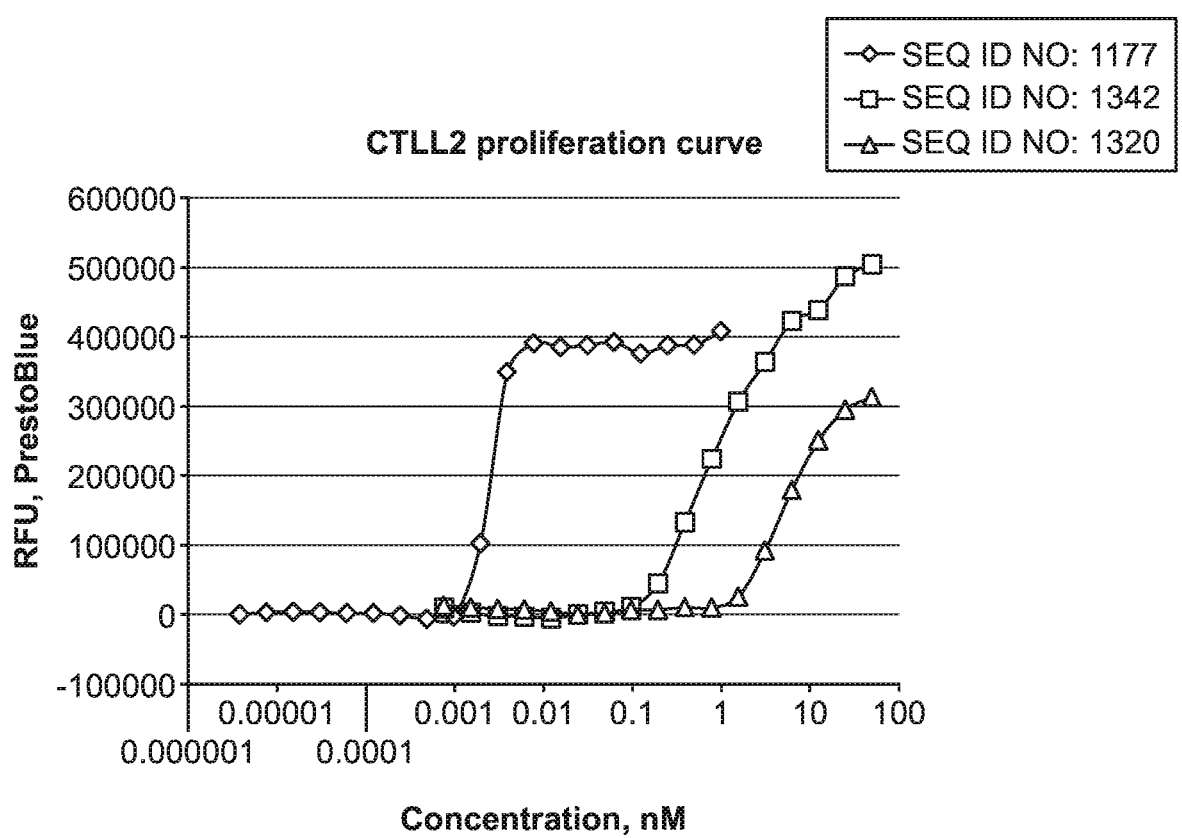
FIG. 28B illustrates the CTLL2 proliferation curve for SEQ ID NO: 1320, an IL-15 (SEQ ID NO: 1177), and a His-tagged RLI (SEQ ID NO: 1342). Each data point represents an average of n=3. RFU-relative fluorescence units.

Peptide-I/O complexes comprising SEQ ID NO: 568 retain cytokine activity and stimulate proliferation in the CTLL2, Mo7e, and CD8+ primary human T cells. FIG. 28 illustrates proliferation curves for CTLL2 cells. FIG. 28A illustrates proliferation curves for CTLL2 cells after exposure to increasing concentrations of SEQ ID NO: 1317, SEQ ID NO: 1318, SEQ ID NO: 1319, and SEQ ID NO: 1321 and His-tagged RLI protein (SEQ ID NO: 1342). FIG. 28B illustrates the CTLL2 proliferation curve for SEQ ID NO: 1320, an IL-15 (SEQ ID NO: 1177), and a His-tagged RLI (SEQ ID NO: 1342). Each data point represents an average of n=3. RFU—relative fluorescence units.

Figure 29:
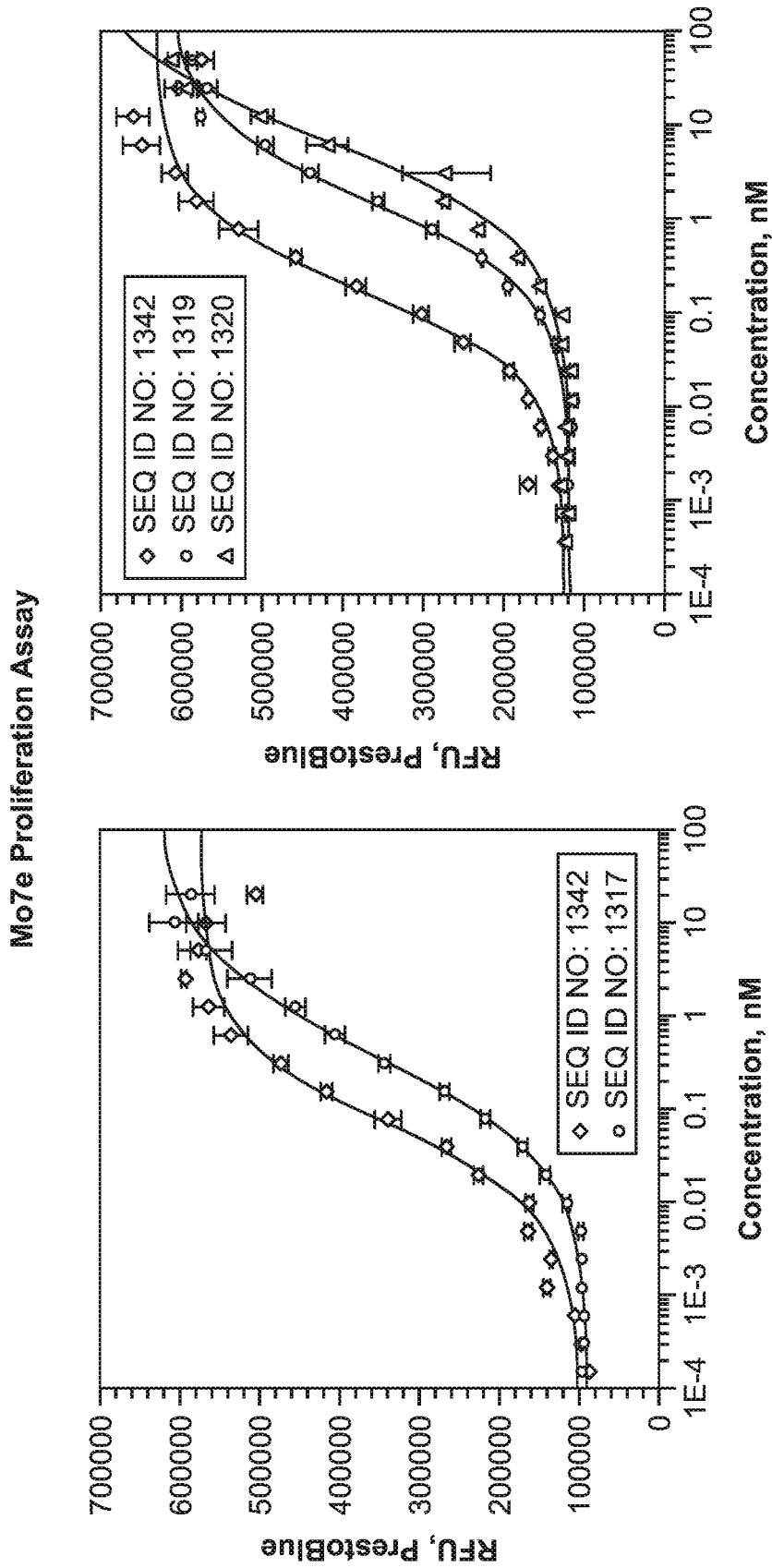
FIG. 29 illustrates proliferation curves for Mo7e cells after exposure to increasing concentration of SEQ ID NO: 1317, SEQ ID NO: 1318, SEQ ID NO: 1319, SEQ ID NO: 1320, and SEQ ID NO: 1321 and a His-tagged RLI (SEQ ID NO: 1342). Each curve shows an n=3 per group and error bars represent standard error of the mean (SEM).
Figure 29:
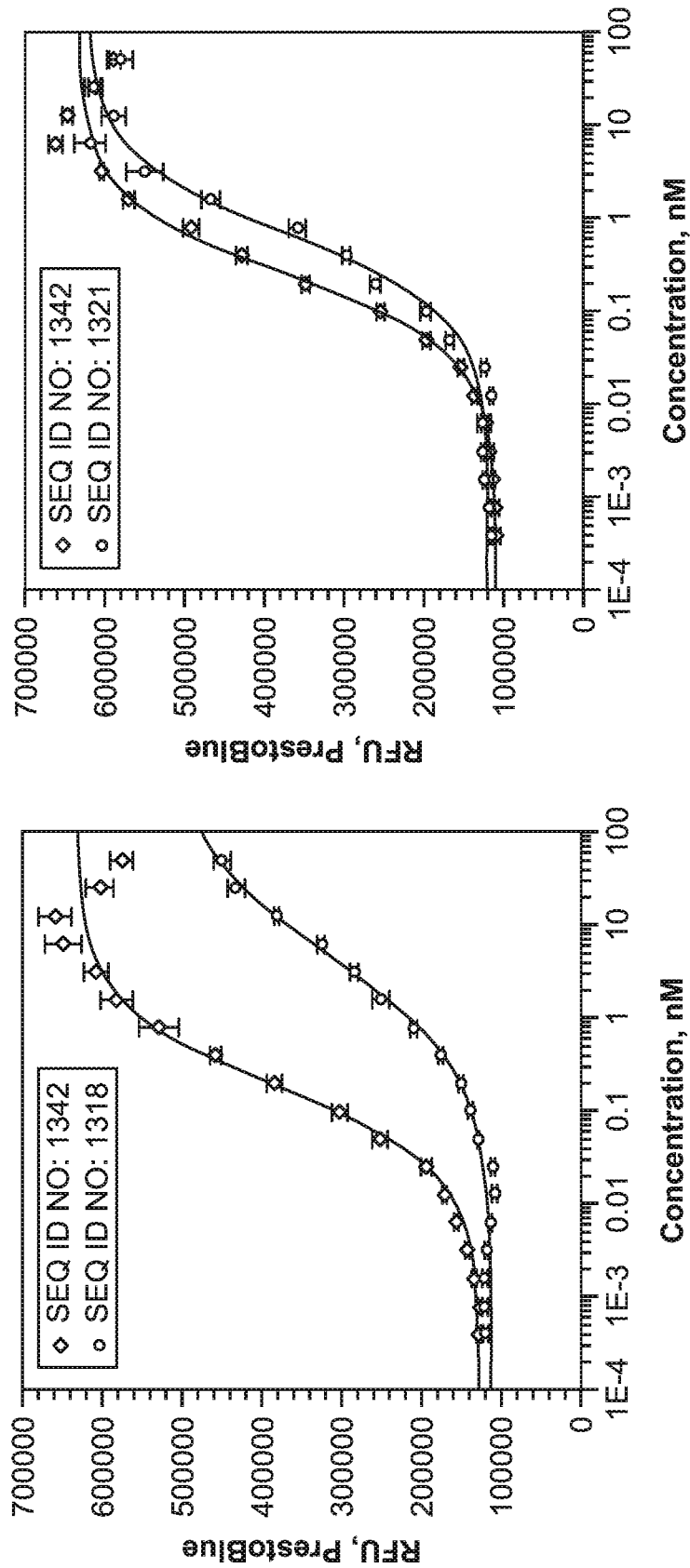
Figure 30A:
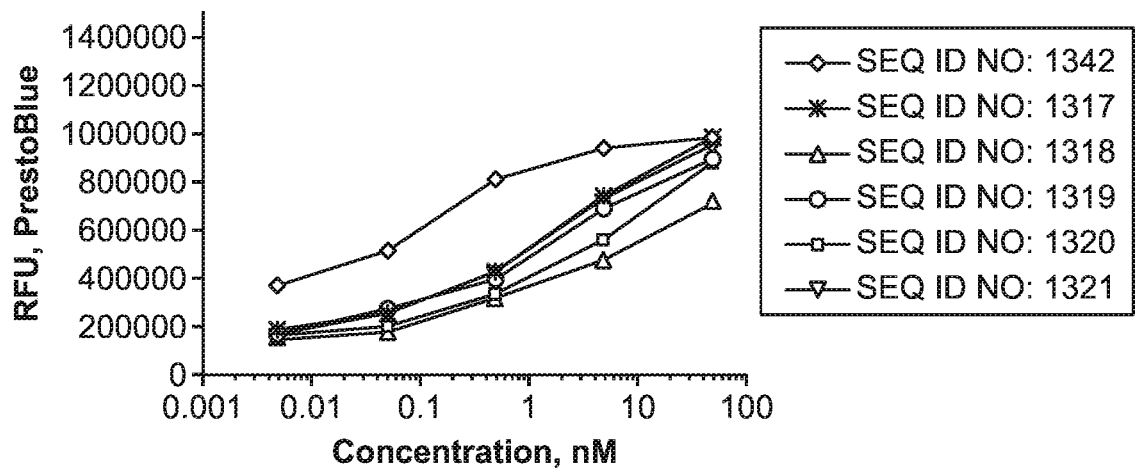
FIG. 30A illustrates proliferation curves for CD8+ primary human T cells after exposure to increasing concentration of SEQ ID NO: 1317, SEQ ID NO: 1318, SEQ ID NO: 1319, SEQ ID NO: 1320, and SEQ ID NO: 1321 and a His-tagged RLI (SEQ ID NO: 1342). Each point on the curve shows an average of n=3 per group. RFU—Relative Fluorescence units.
Figure 30B:
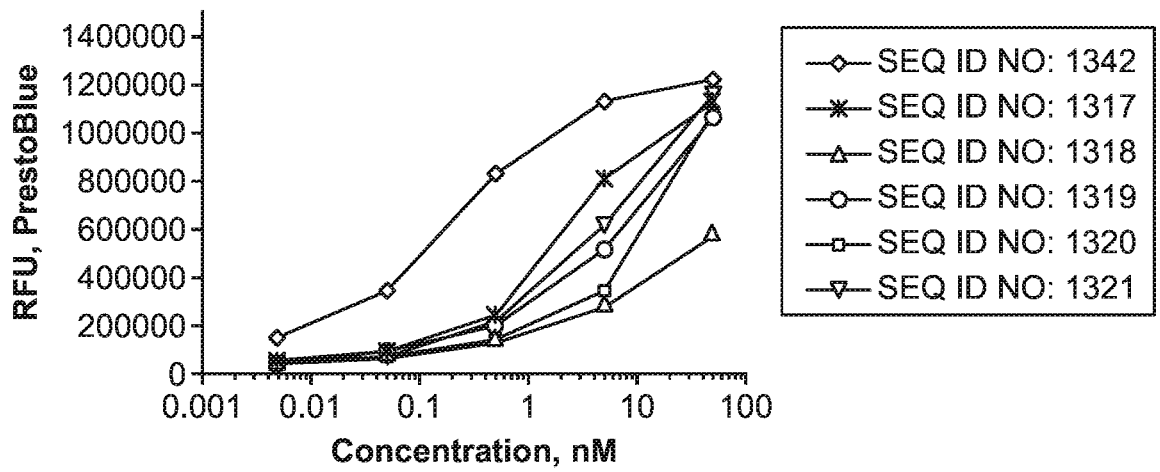
FIG. 30B illustrates proliferation curves for PHA induced T cell blasts from the same CD8 T cell donor as FIG. 30A after exposure to increasing concentration of SEQ ID NO: 1317, SEQ ID NO: 1318, SEQ ID NO: 1319, SEQ ID NO: 1320, and SEQ ID NO: 1321 and a His-tagged RLI (SEQ ID NO: 1342). Each point on the curve shows an average of n=3 per group. RFU—Relative Fluorescence units.

FIG. 29 illustrates proliferation curves for Mo7e cells after exposure to increasing concentration of SEQ ID NO: 1317, SEQ ID NO: 1318, SEQ ID NO: 1319, SEQ ID NO: 1320, and SEQ ID NO: 1321 and a His-tagged RLI (SEQ ID NO: 1342). Each curve shows an n=3 per group and error bars represent standard error of the mean (SEM). The results demonstrate that these IL-15 agents stimulate Mo7e cells. FIG. 30 illustrates proliferation curves for CD8+ primary human T cells and PHA induced T cell blasts from the same CD8+ T cell donor. FIG. 30A illustrates proliferation curves for CD8+ primary human T cells after exposure of increasing concentration of SEQ ID NO: 1317, SEQ ID NO: 1318, SEQ ID NO: 1319, SEQ ID NO: 1320, and SEQ ID NO: 1321 and a His-tagged RLI (SEQ ID NO: 1342). Each point on the curve shows an average of n=3 per group. RFU—Relative Fluorescence units. FIG. 30B illustrates proliferation curves for PHA induced T cell blasts from the same CD8+ T cell donor as FIG. 30A after exposure of increasing concentration of SEQ ID NO: 1317, SEQ ID NO: 1318, SEQ ID NO: 1319, SEQ ID NO: 1320, and SEQ ID NO: 1321 and a His-tagged RLI (SEQ ID NO: 1342). Each point on the curve shows an average of n=3 per group. RFU—Relative Fluorescence units. These data demonstrate that these IL-15 agents stimulate human CD8+ T cells.

In Vitro Proliferation of Cells Treated with SEQ ID NO: 569-IL-15 Agent Complexes.

Unpurified supernant from HEK293 cells transfected with an expression plasmid containing SEQ ID NO: 1328 (and thus expected to secrete the protein of SEQ ID NO: 1328 into the supernatant) were tested for cytokine activity using the Mo7e proliferation assay. Mo7e cells are a cytokine dependent human megakaryoblastic leukemia cell line and are maintained in culture media containing IL-3 but will also proliferate in response to IL-15 stimulation. Viability and cell concentration was analyzed using a Viacell cell counter. After counting, the required number of cells were removed from the suspension culture, washed 3 times with culture media to remove any residual IL-3, and resuspended in media that did not contain the cytokine supplement. Mo7e cells were cytokine starved by placing them in a culture flask and incubating at 37° C., 5% $CO_2$ for 4 hours. Cells were then added to the wells containing unpurified SEQ ID NO 1328-containing supernatant, HEK293 conditioned media that was not transfected with an expression vector ("mock", SEQ ID NO: 1328 expression), or media only ("no treatment") at a final 110 fold dilution and incubated for 3 days. Additional wells that contained growth media without cells were included as a blank for the assay.

After the end of the incubation period, PrestoBlue live cell assay reagent (Invitrogen) was added to each well per manufacture instructions. Plates were then returned to the incubator for 4 hours. PrestoBlue fluorescence was quantified using an Envision (Perkin Elmer 2104) plate reader.

Figure 83:
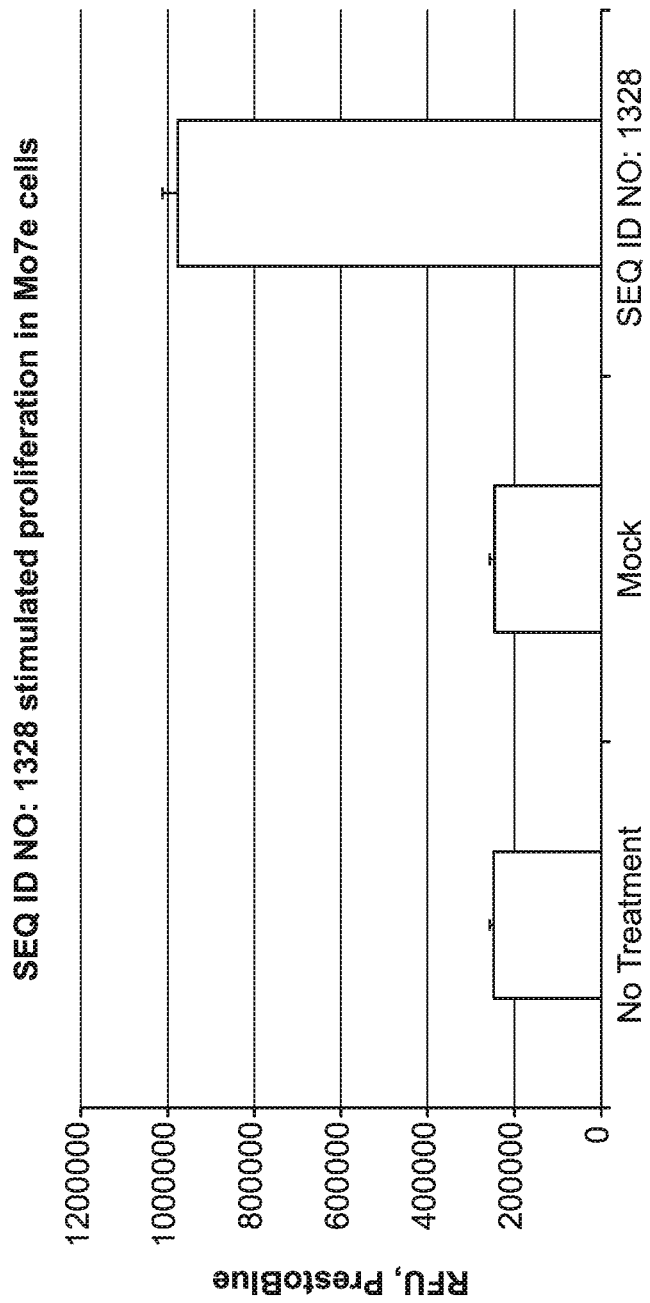
FIG. 83 illustrates the fluorescent signal in relative fluorescence units (RFUs) from the PrestoBlue live cell assay 3 days after treating Mo7e cells with culture media conditioned with HEK293 cell transfected with a SEQ ID NO: 1328 expression vector or HEK293 condition media from non-transfected cells (mock negative control). Untreated Mo7e cells are also included as an additional negative control. Error bars represent Standard Deviation n=3.

Peptide-I/O complex comprising SEQ ID NO: 1328 exhibit cytokine activity and stimulate proliferation in Mo7e cells. FIG. 83 illustrates the fluorescent signal in relative fluorescence units (RLUs) from the PrestoBlue live cell assay 3 days after treating Mo7e cells with conditioned media (supernatant) from HEK293 cells transfected with a SEQ ID NO: 1328 expression vector or HEK293 condition media from non-transfected cells (mock negative control). Untreated Mo7e cells are also included as an additional negative control. Error bars represent Standard Deviation (n=3 per group). This demonstrates that the peptide-I/O complex comprising seq id no: 1328 stimulates the Mo7e cells.

Any peptide of the present disclosure can comprise a peptide-IL-15 agent complex with similar results, including any peptide of SEQ ID NO: 1, SEQ ID NO: 2, SEQ ID NO: 568, SEQ ID NO: 569 or SEQ ID NO: 570, or any peptide that is 80%, 85%, 90%, 95%, 96%, 97%, 98%, 99% or more identical to any of the foregoing.

Example 87

Tumor Cell Responses to Peptide-I/O Complexes

This example describes tumor cell responses, including interferon production, induction of an anti-tumor gene expression profile including interferon stimulated genes, and apoptosis, with peptide-I/O complexes. A peptide-I/O complex of this disclosure was tested for its ability to cause apoptosis and induce an interferon response in a tumor in vivo using CT26 colon carcinoma cells and A20 lymphoma cells. A peptide-I/O complex of FIG. 37 was assessed in Female Balbc mice.

To create flank tumors, mice were inoculated with 0.2 million CT26 cells in a 100 µL volume. Test articles were injected directly into the tumors with a proprietary microinjector device, allowing local separate injection of 4 separate test groups into the same tumor at different locations, as described in Klinghoffer, R. A. et al. A technology platform to assess multiple cancer agents simultaneously within a patient's tumor. SciTranslMed 7, 284ra258, doi:10.1126/scitranslmed.aaa7489 (2015) and Moreno-Gonzalez, A., Olson, J. M. & Klinghoffer, R. A. Predicting responses to chemotherapy in the context that matters—the patient. Mol-Cell Oncol 3, e1057315, doi:10.1080/23723556.2015.1057315 (2016). Each test article was admixed with a fluorescent tracking marker (FTM) prior to injection to allow identification of the location of each injection within a tumor. Mice were enrolled in microinjection studies when the implanted tumors reached the following approximate dimensions: 9 mm (length), 8 mm (width) and 3 mm (depth). The microinjection device was configured with 4 injection needles with a total volume delivery of 1.2 µL per needle per tumor injection. A fluorescent tracking marker (FTM) was added to injection contents for spatial orientation. Total amounts of agents injected per site were a: 1 µg (60 pmol) of a peptide-I/O complex of FIG. 37, b: 50 µM of chloroquine diphosphate salt, c: 1 ug of a peptide-I/O complex of FIG. 37 plus 50 µM of chloroquine, or d: 0.6 µg (48 pmol) of 5'ppp-dsRNA (Invivogen) formulated in in vivo-jetPEI (Polyplus/VWR) as per manufacturer's instructions (including 12.5 µL of the 5'ppp dsRNA stock, 4 µL of in vivo-jetPEI reagent, 25 µL of 10% glucose, 2.5 µL of FTM, and 6 µL of water, resulting in final glucose concentration 5% and an N/P ratio of 8) where the 5'ppp-dsRNA is double stranded RNA with a 5'ppp on the sense strand and of SEQ ID NO: 1424 and SEQ ID NO: 1425. Tumors were resected for analyses at 4 and 24 hours post microinjection. Resected tumors were fixed, processed, stained and scanned as described in Klinghoffer ref. Rabbit anti-CC3 antibody (Cell Signaling #9661, 1:150 dilution) was used for immunohistochemical assays. For immunofluorescent detection, secondary antibody conjugated to AlexaFluor647 (#111-605-144 Jackson Immuno research, 1:600 dilution) was applied as per manufacturer's instructions and tissues were counterstained with DAPI. H&E staining was carried out for general histological assessment.

Figure 16:
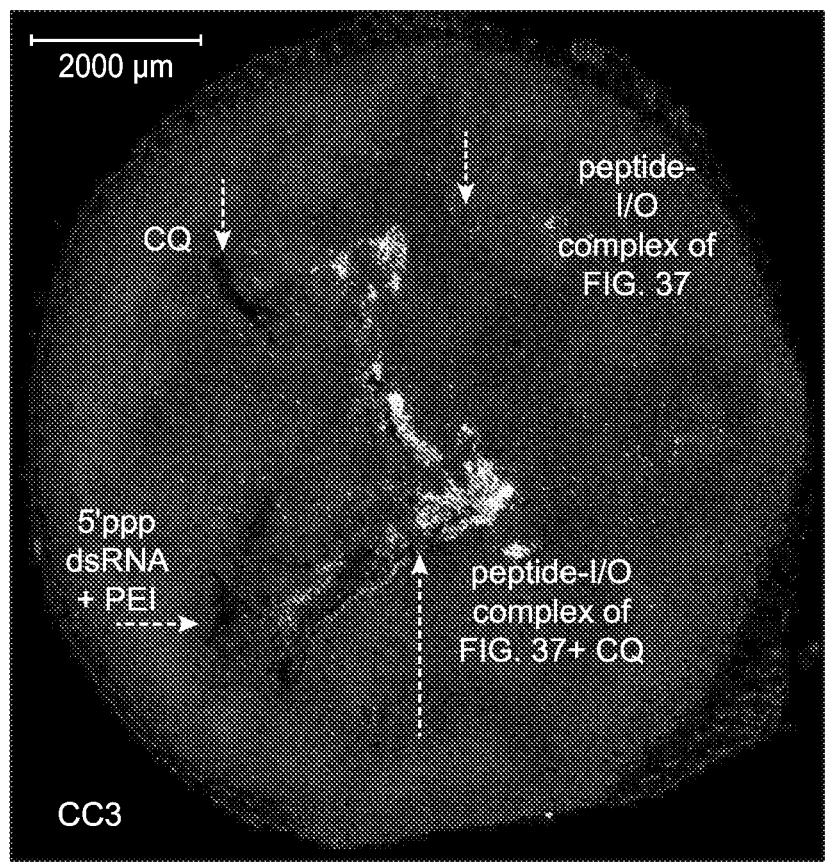
FIG. 16 illustrates a CT26 tumor sample that was microinjected with a peptide-I/O complex of FIG. 37, a peptide-I/O complex of FIG. 37+chloroquine, chloroquine (CQ), or 5'ppp dsRNA+PEI and harvested and stained 4 hours post-treatment. The dotted arrows indicate some of the locations of the injections and the white punctate spots indicate CC3 staining. A large region showed CC3 staining for the site injected with the peptide-I/O complex of FIG. 37+chloroquine, whereas the sites injected with a peptide-I/O complex of FIG. 37, chloroquine, or 5'ppp dsRNA+PEI did not have a significant region of CC3 staining.
Figure 16:
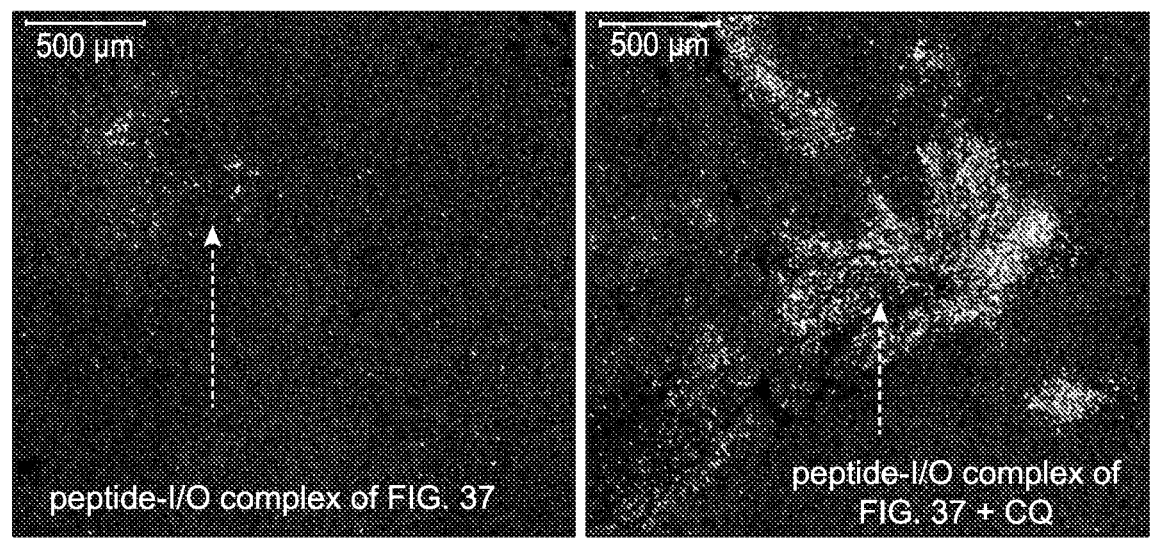
Figure 17:
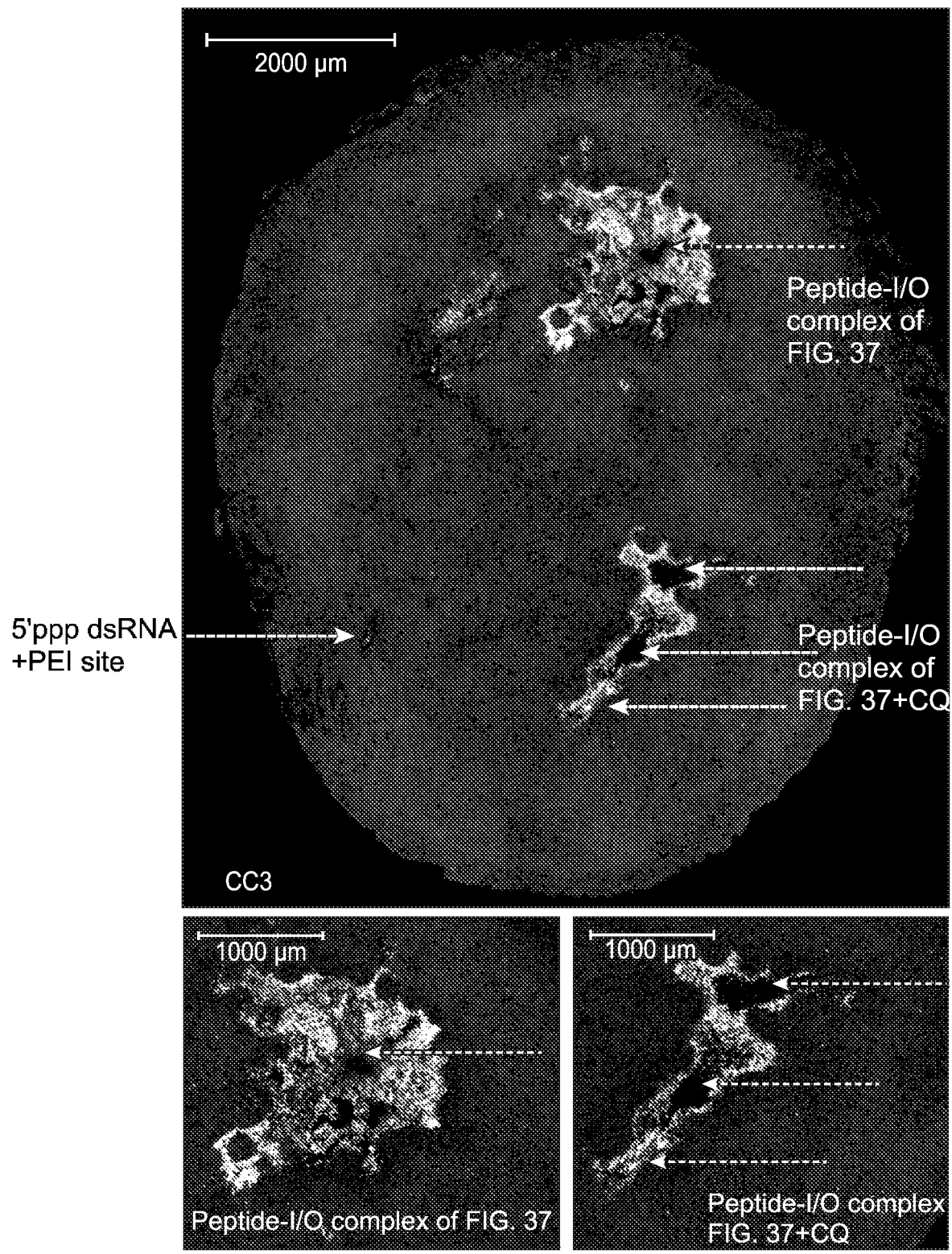
FIG. 17 illustrates a CT26 tumor sample from a different animal that was microinjected with a peptide-I/O complex of FIG. 37, a peptide-I/O complex of FIG. 37+chloroquine, chloroquine, or 5'ppp dsRNA+PEI and harvested and stained 24 hours after treatment. The dotted arrows indicate some of the locations of the injections and the white punctate spots indicate some of the CC3 staining. A large region showed CC3 staining for the site injected with the peptide-I/O complex of FIG. 37 and for the site injected with the peptide-I/O complex of FIG. 37+chloroquine, whereas the sites injected with 5'ppp dsRNA+PEI did not have a significant region of CC3 staining. The site injected with chloroquine is not present in this tumor sample.
Figure 18:
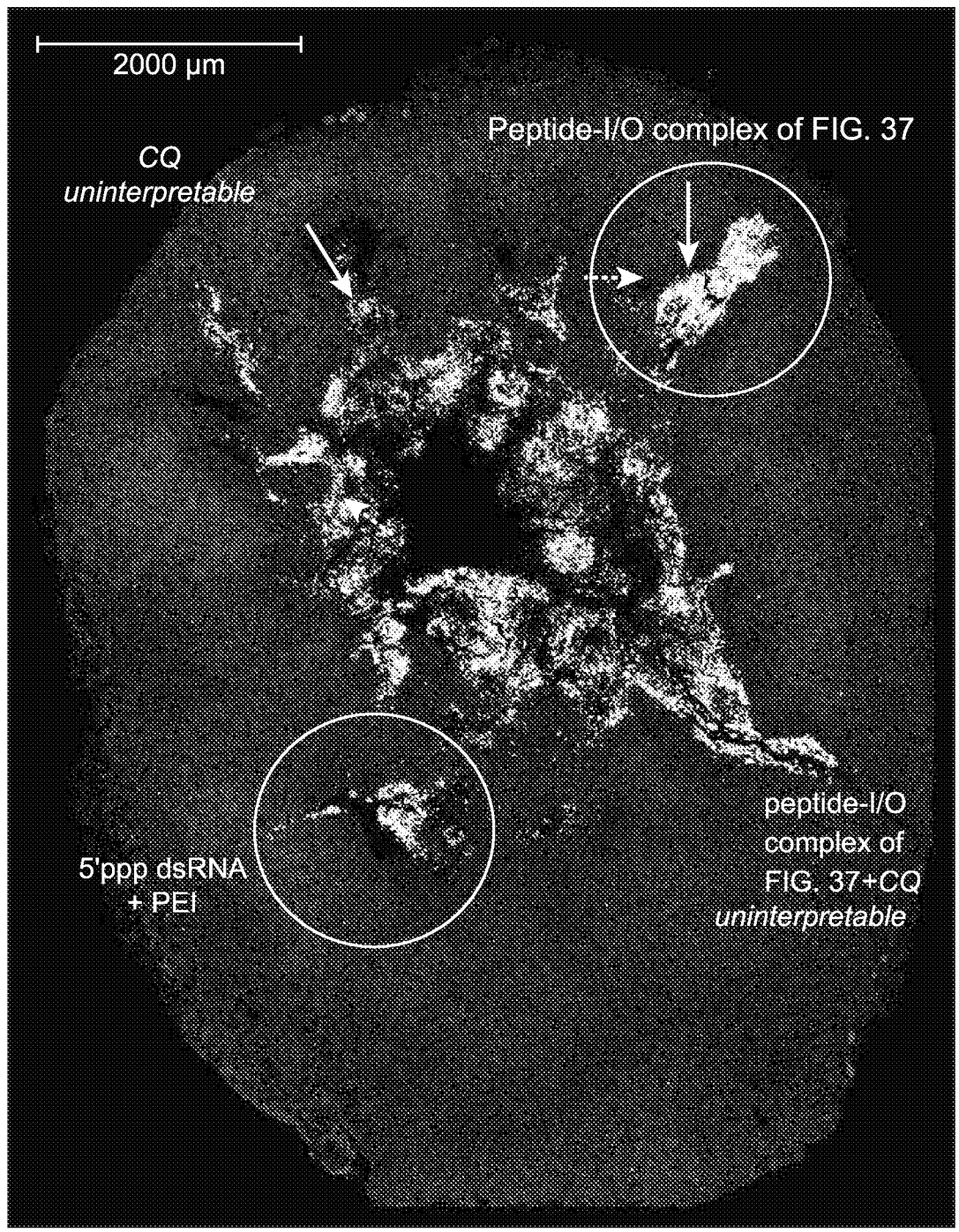
FIG. 18 illustrates a CT26 tumor sample from a different animal that was microinjected with a peptide-I/O complex of FIG. 37, a peptide-I/O complex of FIG. 37+chloroquine, chloroquine, or 5'ppp dsRNA+PEI and harvested and stained 24 hours after treatment. The arrows or circled areas indicate some of the locations of the injections and the white punctate spots indicate some of the CC3 staining. A large region showed CC3 staining for the site injected with the peptide-I/O complex of FIG. 37 and for the site injected with 5'ppp dsRNA+PEI. The CQ and the peptide-I/O complex of FIG. 37+chloroquine are uninterpretable due to merging with a general area of tumor necrosis in this sample.

Results of the experiment are shown in FIG. 16-FIG. 18 and FIG. 86. Images were captured using Panoramic Viewer; brightness and contrast were adjusted using Adobe Photoshop software. Image panels (as required for high magnification figures) were generated using Adobe Illustrator and then adjusted as above when required. Colocalization of the FTM from a test article treatment group along with localized cleaved caspase 3 (CC3) staining indicates apoptosis caused by the test article injection, which can indicate activation of the RIG-I pathway by delivery of the oligonucleotide to the RIG-I helicase located in the cytoplasm of the CT26 cancer cells. FIG. 16 illustrates a CT26 tumor sample that was microinjected with a peptide-I/O complex of FIG. 37, a peptide-I/O complex of FIG. 37+chloroquine, chloroquine (CQ), or 5'ppp dsRNA+PEI and harvested and stained 4 hours post-treatment. The upper image shows the entire tumor sample and bottom images are zoomed in to specific regions of treatment as labeled. The dotted arrows indicate some of the locations of the injections (traced via the FTM) and the white punctate spots indicate CC3 staining. A large region showed CC3 staining for the site injected with the peptide-I/O complex of FIG. 37+chloroquine, whereas the sites injected with a peptide-I/O complex of FIG. 37 alone, chloroquine alone, or 5'ppp dsRNA+PEI did not have a significant region of CC3 staining. Bottom images show further zoomed in views of staining. In FIG. 16, CC3 apoptosis marker is colocalized with the peptide-I/O complex of FIG. 37+chloroquine test article, indicating apoptosis induction at 4 hours by this peptide-I/O complex of FIG. 37+chloroquine. There is not clear evidence of significant costaining of CC3 with the other test articles in this sample. FIG. 17 illustrates a CT26 tumor sample from a different animal that was microinjected with a peptide-I/O complex of FIG. 37, a peptide-I/O complex of FIG. 37+chloroquine, chloroquine, or 5'ppp dsRNA+PEI and harvested and stained 24 hours after treatment. The upper image shows the entire tumor sample and bottom images are zoomed in to specific regions of treatment as labeled. The dotted arrows indicate some of the locations of the injections and the white punctate spots indicate some of the CC3 staining. A large region showed CC3 staining for the site injected with the peptide-I/O complex of FIG. 37 and for the site injected with the peptide-I/O complex of FIG. 37+chloroquine and these are zoomed in in the bottom images, whereas the site injected 5'ppp dsRNA+PEI did not have a significant region of CC3 staining. Both a peptide-I/O complex of FIG. 37 and a peptide-I/O complex of FIG. 37+chloroquine show strong colocalized staining with CC3, indicating apoptosis induction at 24 hours by both a peptide-I/O complex of FIG. 37 and a peptide-I/O complex of FIG. 37+chloroquine. There is not co-staining with CC3 evident with the 5'ppp dsRNA+PEI) injection (the chloroquine site is not present in this tumor sample). FIG. 18 illustrates a CT26 tumor sample from a different animal that was microinjected with a peptide-I/O complex of FIG. 37, a peptide-I/O complex of FIG. 37+chloroquine, chloroquine, or 5'ppp dsRNA+PEI and harvested and stained 24 hours after treatment. The arrows or circled regions indicate some of the locations of the injections and the white punctate spots indicate some of the CC3 staining. A large region showed CC3 staining for the site injected with the peptide-I/O complex of FIG. 37 and for the site injected with 5'ppp dsRNA+PEI. The CQ and the peptide-IO complex of FIG. 37+chloroquine injection sites are uninterpretable due to merging with a general area of tumor necrosis in this sample. Both a peptide-I/O complex of FIG. 37 and 5'ppp dsRNA+ PEI show strong colocalized staining with CC3, indicating apoptosis induction at 24 hours by both a peptide-I/O complex of FIG. 37 and 5'ppp dsRNA+PEI. TSignals varied in different animals tested. One animal showed CC3 staining at 24 h at a site injected solely by chloroquine. This data indicates the ability of a peptide-I/O complex of FIG. 37 to induce localized apoptosis upon injection into a tumor (and without any PEI or transfection reagent). The addition of chloroquine co-injected with a peptide-I/O complex of FIG. 37 might accelerate the apoptotic response. In order to induce an apoptotic response via the Rig-I pathway, the peptide-I/O complex of FIG. 37 would need to be delivered to the Rig-I helicase located in the cytosol of cells in the tumor. This indicates that the peptide-I/O complex of FIG. 37 may be able to deliver the 5'ppp hairpin RNA to the cytosol. 5'ppp dsRNA+PEI also showed apoptotic response in a tumor as shown in FIG. 18, where the cytosolic delivery of the 5'ppp dsRNA may have been achieved to do the transfection reagent PEI causing cytosolic delivery of the dsRNA.

Figure 26A:
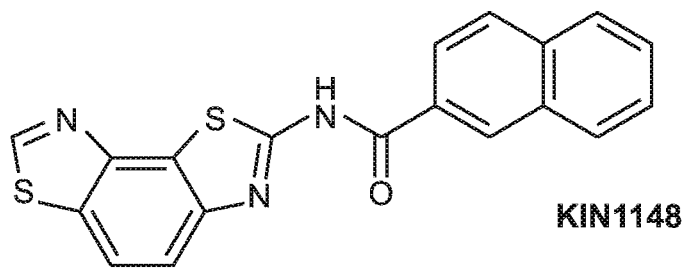
FIG. 26A illustrates the structure of KIN1148.
Figure 26B:
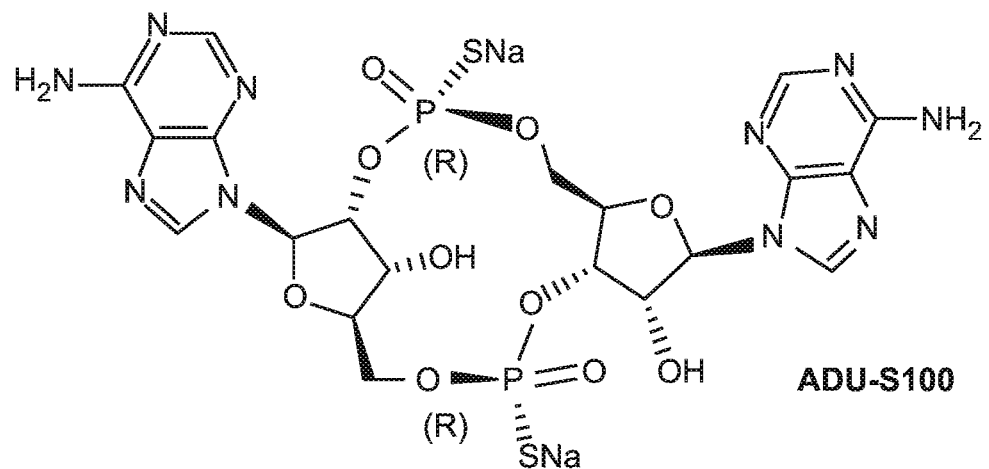
FIG. 26B illustrates the structure of ADU-S100.
Figure 26C:
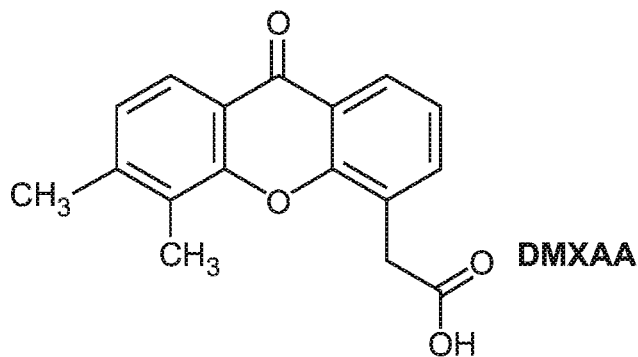
FIG. 26C illustrates the structure of DMXAA.

In another experiment, BalbC mice were similarly inoculated with A20 lymphoma cells to form a tumor and were enrolled when the implanted tumors reached the following approximate dimensions: 14 mm (length), 10 mm (width) and 7 mm (depth). They were dosed with multiple test articles via microinjection with a device that can inject at 6 locations simultaneously (here, 1.2 µL per injection site), euthanized at 4 and 24 hours, and tumors stained for various markers similarly. Total amounts of agents injected per site were 1 or 2 µg (60 or 120 pmol) of a peptide-I/O complex of FIG. 37, 0.74 µg (60 pmol) of 5'ppp-hpRNA (SEQ ID NO: 1371), 0.6 µg (48 pmol) of 5'ppp-dsRNA formulated in in vivo jet PEI as per manufacturer's instructions, 1 ug (3542 pmol) of DMXAA (FIG. 26D), or PBS. 5'ppp-dsRNA in in vivo jet PEI formulation included 5 µL of a 5'ppp dsRNA stock, 4 µL of in vivo-jetPEI reagent, 25 µL of 10% glucose, 2.5 µL of FTM, and 13.5 µL of water, resulting in final glucose concentration 5% and an N/P ratio of 8). The 5'ppp-dsRNA is double stranded RNA with a 5'ppp on the sense strand of SEQ ID NO: 1424 complexed with SEQ ID NO: 1425.

Figures 81, 81A, 81B:
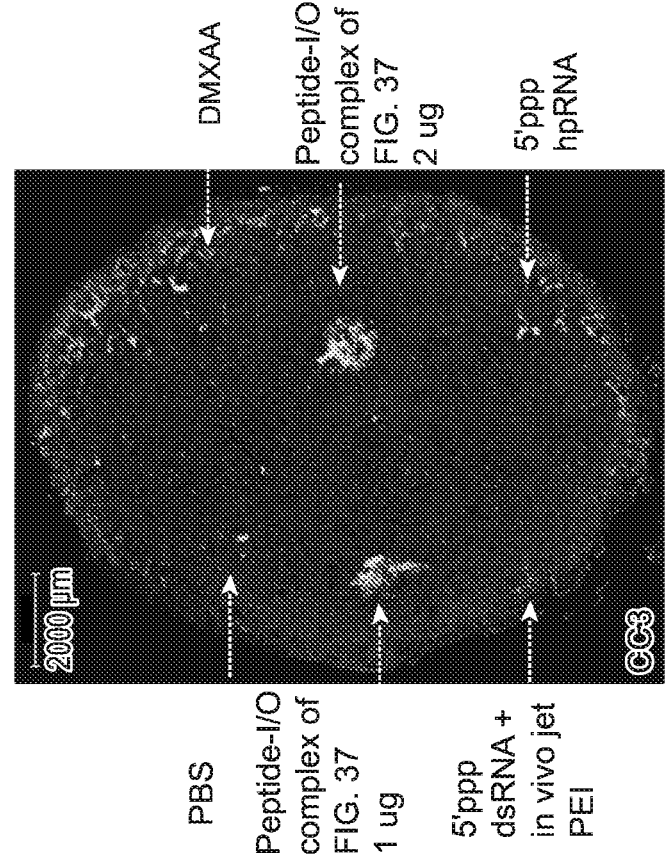
FIG. 81 illustrates an A20 lymphoma sample that was microinjected with a peptide-I/O complex of FIG. 37, PBS, DMXAA, 5'ppp dsRNA+in vivo jet PEI, and 5'ppp hpRNA. The white punctate spots indicate CC3 staining. Images were taken 24 hours after administration. "5'ppp dsRNA" is also the I/O comprising a dsRNA of two separate RNA strands complexed together comprising SEQ ID NO: 1424 and SEQ ID NO: 1425 (where 5'ppp is located on seq id no 1424). "5'ppp hpRNA" is an I/O comprising a dsRNA SEQ ID NO: 1371 with a 5'ppp (which SEQ ID NO: 1371 forms a hairpin structure).
FIG. 81A illustrates a zoomed out image of the A20 lymphoma sample that has been microinjected with a peptide-I/O complex of FIG. 37 at 1 ug and 2 ug, PBS, DMXAA, 5'ppp dsRNA+in vivo jet PEI, and 5'ppp hpRNA.
FIG. 81B illustrates zoomed in images of the PBS region, the 5'ppp hpRNA region, the region in which a peptide-I/O complex of FIG. 37 at the 2 ug dose showed activity, and the region in which a peptide-I/O complex of FIG. 37 at the 1 ug dose showed activity. CC3 staining is shown by white punctate spots.

FIG. 81 illustrates an A20 lymphoma sample that was microinjected with a peptide-I/O complex of FIG. 37, PBS, DMXAA, 5'ppp dsRNA+in vivo jet PEI, and 5'ppp hpRNA. The white punctate spots indicate CC3 staining. Images were taken 24 hours after administration. FIG. 81A illustrates a zoomed out image of the A20 lymphoma sample that has been microinjected with a peptide-I/O complex of FIG. 37 at =1 µg and 2 µg, PBS, DMXAA, 5'ppp dsRNA+in vivo jet PEI, and 5'ppp hpRNA; the regions of injection are labeled with text. FIG. 81B illustrates zoomed in images of the PBS region, the 5'ppp hpRNA region, the region in which a peptide-I/O complex of FIG. 37 at the 2 µg dose was injected, and the region in which a peptide-I/O complex of FIG. 37 at the 1 µg dose was injected. CC3 staining is shown by white punctate spots. The peptide-I/O complex of FIG. 37 at both 1 µg and 2 µg doses show strong colocalized staining with CC3, indicating the induction of apoptosis by injection of this test article. The other injected sites on this sample do not show similarly strong induction of apoptosis.

Quantitative analysis of drug responses was performed as previously described (Klinghoffer, R. A. et al. Sci Transl Med (2015); Dey, J. et al PLoS One (2016)). Injection sites were automatically identified with the help of the FTM, then within circular regions of interest centered on the injection site, cells are automatically identified and assigned to different classes based on their staining patterns. The fraction of cells belong to each class (e.g., CC3 positive) are mapped as a function of radial distance. For comparison of responses induced by two agents, the radial effect curves for each agent alone and a vehicle control are used in conjunction with a linear mixed effects model to estimate whether the response from one agent is significantly greater than the other.

Figure 82:
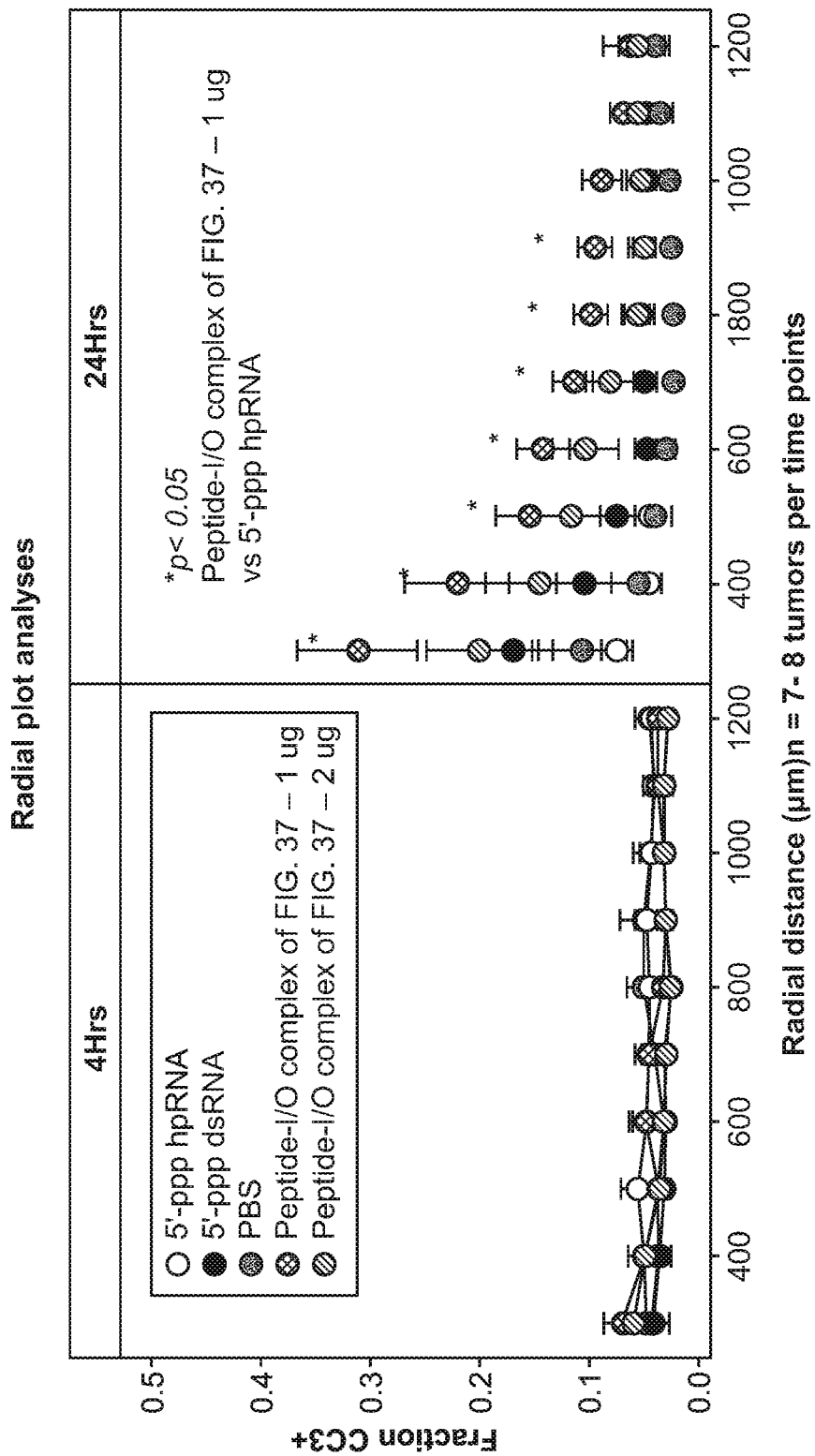
FIG. 82 illustrates a radial plot analysis comparing peptide-I/O complexes to free I/Os and a negative control (PBS) at 4 hours and 24 hours post administration.

FIG. 82 is a radial plot analysis of what fraction of cells are positive for CC3 staining as the distance from an injection site is increased (a fraction of 0.3 indicates 30% of cells are positive) for a total of 7-8 tumors for each test article, at the 4 hour and 24 hour timepoint. At the 24 hour timepoint, the peptide-I/O complex of FIG. 37 at both 1 µg and 2 µg doses shows increased fraction of CC3 positive cells closer to the site of injection of the test article, whereas PBS or 5'ppp hpRNA show very little increase in CC3 positive cells close to the injection site. The addition of the transfection reagent PEI combined with 5'ppp dsRNA also results in some increase in CC3 positive cells. The increase in fraction of cells that are CC3 positive near the injection site of test article is significantly higher where 60 pmol (1 µg) of peptide-I/O complex of FIG. 37 is injected than near where an equimolar amount of 5'ppp hpRNA is injected (P<0.05 indicated by * on the graph). Because peptide-I/O complex of FIG. 37 comprises the same 5'ppp hpRNA sequence but also has the peptide of this disclosure added, this indicates that the combination of the peptide of this disclosure with the Rig-I I/O agent 5'ppp hpRNA increases its ability to cause apoptosis in the cells, which could be due to cytosolic delivery of the 5'ppp hpRNA to the Rig-I helicase.

In addition, tumor samples from both experiments were also stained for induction of IFNb response. Interferon beta (IFNb) response was detected using in situ hybridization using the RNAscope multiplex fluorescent reagent kit v2 (Advanced Cell Diagnostics) following the manufacturer's instructions. The RNAscope ISH assay is completed with a mouse IFNb1 probe and TSA Plus Cyanine 5 detection. The slides are counterstained with DAPI and imaged.

Figure 86:
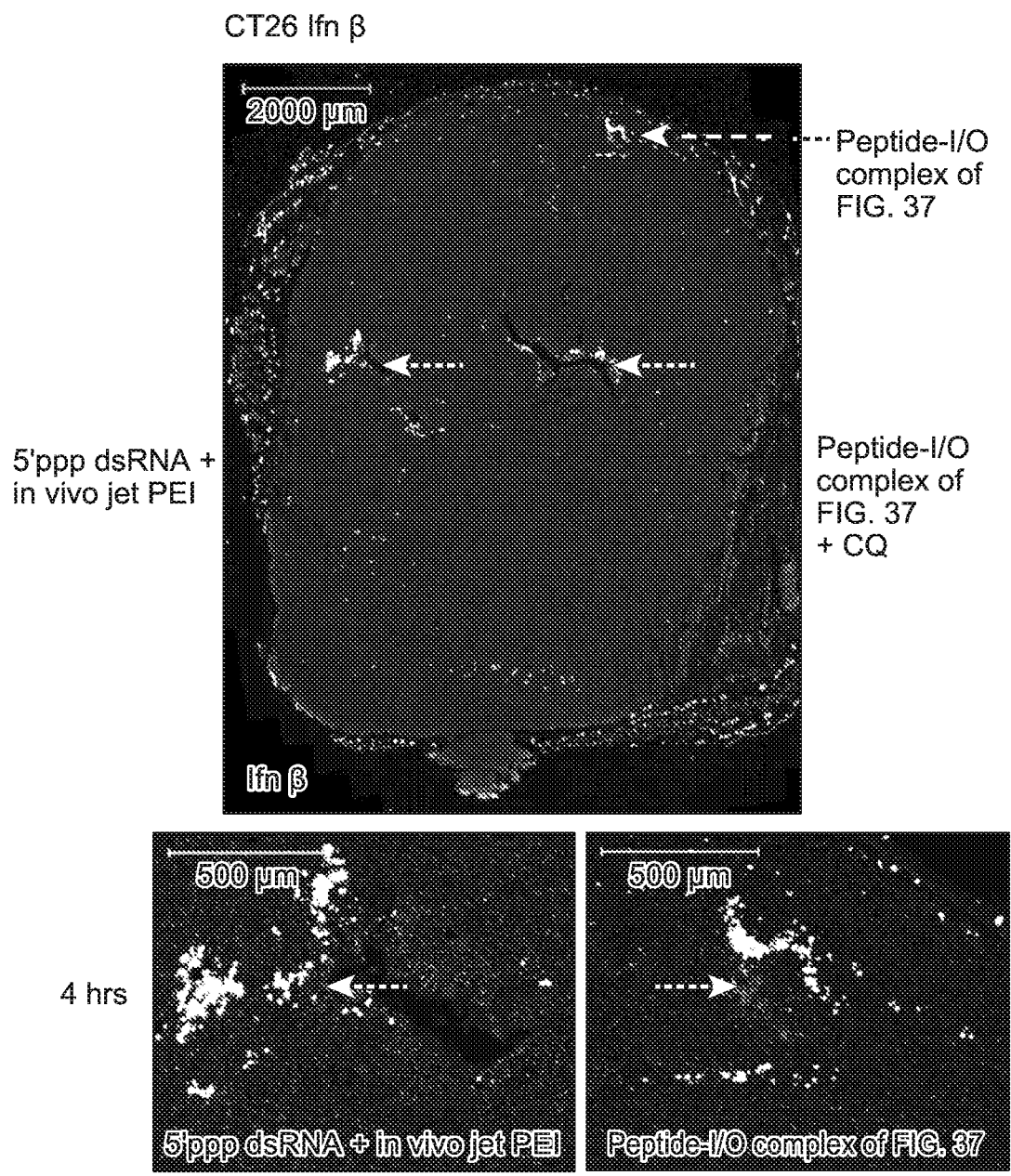
FIG. 86 illustrates the activity of a peptide-I/O complex of FIG. 37 to induce an interferon beta (Ifnβ) response in a tumor in vivo using CT26 colon carcinoma cells grown in Female Balbc mice. The CT26 tumor sample was microinjected with a peptide-I/O complex of FIG. 37, chloroquine, the peptide-I/O complex of FIG. 37 plus chloroquine, or 5'ppp-dsRNA (the dsRNA as described in FIG. 81). The FIG. shows low magnification image of the tumor sample and high magnification images of select test sites in the CT26 colon carcinoma cells after 4 hours, as labeled.

FIG. 86 illustrates a CT26 tumor sample that was microinjected with a peptide-I/O complex of FIG. 37, a peptide-I/O complex of FIG. 37+chloroquine, chloroquine (CQ), or 5'ppp dsRNA+PEI and harvested and stained 4 hours post-treatment. The upper image shows the entire tumor sample and bottom images are zoomed in to specific regions of treatment as labeled. The dotted arrows indicate some of the locations of the injections (traced via the FTM) and the white punctate spots indicate IFNb mRNA staining. The site of chloroquine injection is not present in this sample. Significant staining for IFNb mRNA is seen in the regions that were injected with the peptide-I/O complex of FIG. 37 and for the region injected with 5'ppp dsRNA+PEI, as seen in the top image and zoomed in in the bottom images. This indicates the ability of the peptide-I/O complex of FIG. 37 to generate an IFNb response, without use of transfection reagent, which can indicate delivery of the I/O RNA to the cytosol and Rig-I pathway engagement.

Figure 84:
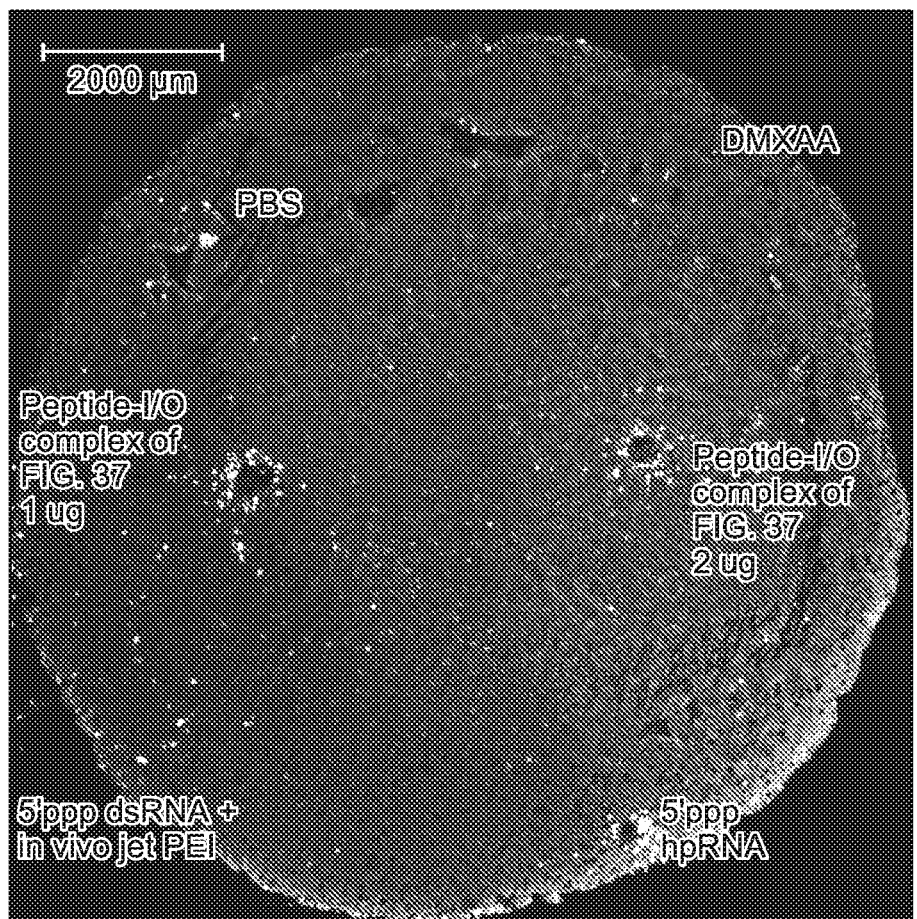
FIG. 84 and FIG. 85 illustrates the activity of a peptide-I/O complex of FIG. 37 to induce an interferon beta (Ifnβ) response in a tumor in vivo using A20 lymphoma cells grown in Female Balbc mice. The A20 lymphoma sample that was microinjected with a peptide-I/O complex of FIG. 37, PBS, DMXAA, 5'ppp dsRNA+in vivo jet PEI, and 5'ppp hpRNA (each of the foregoing as described in FIG. 81).
Figure 85:
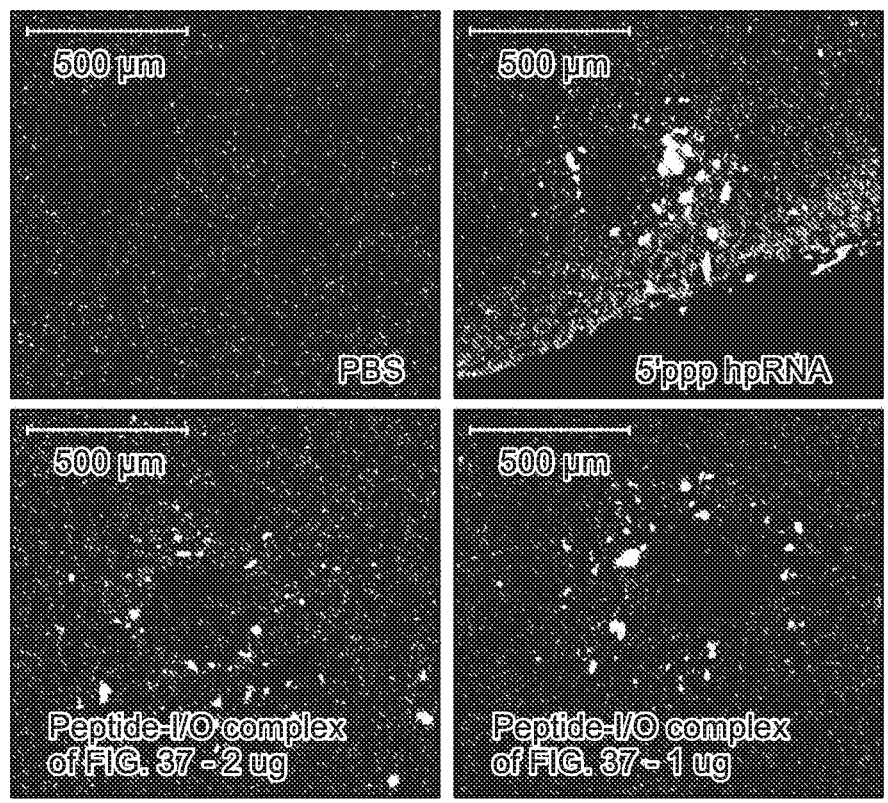

FIG. 84 and FIG. 85 illustrates an A20 lymphoma sample from the above experiment that was microinjected with a peptide-I/O complex of FIG. 37, PBS, DMXAA, 5'ppp dsRNA+in vivo jet PEI, and 5'ppp hpRNA. The white punctate spots indicate IFNb mRNA staining. Images were taken 4 hours after administration. FIG. 84 illustrates a zoomed out image of the A20 lymphoma sample that has been microinjected with a peptide-I/O complex of FIG. 37 at 1 µg and 2 µg, PBS, DMXAA, 5'ppp dsRNA+in vivo jet PEI, and 5'ppp hpRNA; the regions of injection are labeled with text. FIG. 85 illustrates zoomed in images of the PBS region, the 5'ppp hpRNA region, the region in which a peptide-I/O complex of FIG. 37 at the 2 µg dose was injected, and the region in which a peptide-I/O complex of FIG. 37 at the 1 µg dose was injected. IFNb mRNA staining is shown by white punctate spots. The regions injected with 1 ug or 2 ug of the peptide-I/o complex of FIG. 37 show significant IFNb mRNA staining. The region injected with 5'ppp hpRNA also shows significant IFNb mRNA staining, whereas the region injected with PBS does not. This indicates the ability of the peptide-I/O complex of FIG. 37 to generate an IFNb response, without use of transfection reagent, which can indicate delivery of the I/O RNA to the cytosol and Rig-I pathway engagement.

Taken together, the results of these experiments demonstrate the ability of the peptide-I/O complex of FIG. 37 to induce IFNb mRNA and to induce apoptosis when delivered in vivo to A20 and CT26 tumors, without use of any transfection reagent. This can indicate the ability of the peptide-I/O complex of FIG. 37 to deliver the RNA I/O to the cytosol of the cells and induce the Rig-I pathway.

Example 88

Treatment of Head and Neck Cancer with a Peptide-I/O Complex

This example illustrates treatment of head and neck cancer using peptide-I/O complexes of the present disclosure. A peptide of the present disclosure is recombinantly expressed or chemically synthesized and are used directly, after conjugation to an I/O. The peptide-I/O complex is administered in a pharmaceutical composition to a subject as a therapeutic for head and neck cancer. One or more peptide-I/O complexes of the present disclosure are administered to a subject. A subject can be a human or an animal. The pharmaceutical composition is administered subcutaneously, intravenously, orally, or injected directly into a tumor. The administered peptide-I/O complexes target head and neck cancer-affected tissues and cells thereof.

The peptide is any peptide with the sequence selected from SEQ ID NO: 1-SEQ ID NO: 1134, SEQ ID NO: 1243-SEQ ID NO: 1262, or SEQ ID NO: 1263-SEQ ID NO: 1316. Such peptide-drug conjugates can be made using either a cleavable or stable linker as described herein (e.g., EXAMPLES 8 and 9).

Example 89

Enzymatic Processing of Peptide-IL-15 Agent Complex

This example describes enzymatic processing of a peptide-IL-15 agent complex of the present disclosure. Peptide-IL-15 agent complexes that are exposed to tumor cells or the tumor microenvironment are processed by enzymes that are present at higher concentration in the tumor environment or in subcellular compartments to which they are delivered, such as by endocytosis into endosomes. This example describes the change in potency of the IL-15 agent in peptide-IL-15 agent complexes after exposure to the enzyme cathepsin B. Cathepsin B can display exopeptidase activity at pH 5 and endopeptidase activity at pH 7. SEQ ID NO: 1317, SEQ ID NO: 1318, SEQ ID NO: 1319-SEQ ID NO: 1320 and SEQ ID NO: 1321 and a His-tagged RLI (SEQ ID NO:1342) were tested for their IL-15 cytokine activity with and without exposure to cathepsin B at pH 7 and pH 5. The pH conditions were selected to mimic the neutral pH of early endosomes that determine endopeptidase activity and more acidic pH 5 dependent exopeptidase activities of later endosomes and lysosomes.

Cathepsin B cleavage was conducted at pH 7 and pH 5. Reaction buffer for the pH 7 condition was PBS+8 mM Cysteine and the reaction buffer for the pH 5 condition was 50 mM sodium acetate+8 mM Cysteine. Fusion proteins were diluted to 2 µM in reaction buffer in a microfuge tube. Cathepsin B (0.44 µg) was added to each reaction and placed in the tissue culture incubator set at 37° C. with 5% $CO_2$ for 2 hours. The control condition did not contain cathepsin B enzyme but was otherwise identical. After the reaction period, 1 M HEPES (1% of the reaction volume) was added to the pH 5 condition in order to neutralize the acidic buffer. Serial dilutions of each reaction was performed using the reaction buffer (1% HEPES was added to the diluent for the pH 5 condition) and then added to the wells of a 96 well plate in triplicate (10 µL per well).

All assays were performed in a 96 well plate format in clear bottom black walled tissue culture plates. CTLL2 cells (mouse cytotoxic T lymphocyte cell line) were maintained as cell cultures in media supplemented with IL-2. Mo7e (human acute megakaryoblastic leukemia cell line) were maintained in media supplemented with IL-3. Viability and cell concentration was analyzed using a Viacell cell counter. After counting, the required number of cells were removed from the suspension culture, washed 3 times, and resuspended in media that did not contain cytokine supplement. Culture media for the pH 5 condition contained HEPES. CTLL2 and Mo7e cells were cytokine starved for 4 hours in the 37° C. tissue culture incubator and then added to the wells containing the peptide-IL-15 agent complexes (5,000 CTLL2 or 20,000 Mo7e cells per well in 90 µL) with a final volume of 100 µL. The plates were returned to the incubator for 2 (CTLL2) or 3 (Mo7e) days. Additional wells that contained growth media without cells were included as a blank for the assay. After the end of the incubation period, PrestoBlue viable cell assay reagent (Invitrogen) was added to each well (10 µL per 100 µL well). Plates were then returned to the incubator for 4-24 hours. Fluorescence was quantified using an Envision (Perkin Elmer 2104) plate reader.

Figure 31:
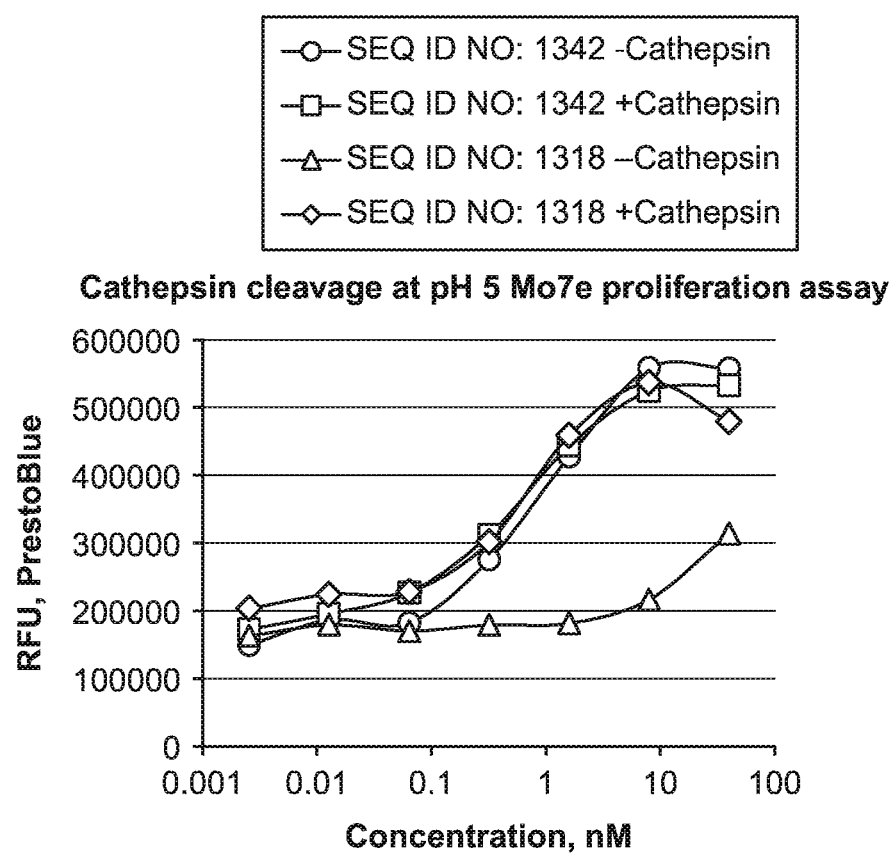
FIG. 31 illustrates cytokine activity, with (+) and without (−) cathepsin B treatment at pH 5, for a His-tagged RLI (SEQ ID NO: 1342) and a peptide-IL-15 agent complex of SEQ ID NO: 1318 in Mo7e cells at various concentrations (nM) of the peptide-IL-15 agent complex or RLI as noted. Each point on the curve shows an average of n=3 per group. Each point on the curve shows an average of n=3 per group.

Cytokine activity was increased in some fusion proteins tested after exposure to cathepsin B at either pH 7 or pH 5. FIG. 31 illustrates cytokine activity, with (+) and without (−) cathepsin B treatment at pH 5, for a His-tagged RLI (SEQ ID NO: 1342) and a peptide-IL-15 agent complex of SEQ ID NO: 1318 in Mo7e cells at various concentrations (nM) of the peptide-IL-15 agent complex or RLI as noted. Each point on the curve shows an average of n=3 per group. Each point on the curve shows an average of n=3 per group. FIG. 31 shows the proliferation curve for SEQ ID NO: 1318 with and without cathepsin B cleavage at pH 5 in Mo7e cells. Without cathepsin B cleavage the potency of SEQ ID NO: 1318 is significantly lower than a His-tagged RLI (SEQ ID NO: 1342). After cathepsin B cleavage, potency increases to levels similar to RLI restoring RLI-like activity in this Peptide-IL-15 complex. FIG. 32 illustrates Cathepsin B cleavage in a CTLL2 proliferation assay.

Figure 32A:
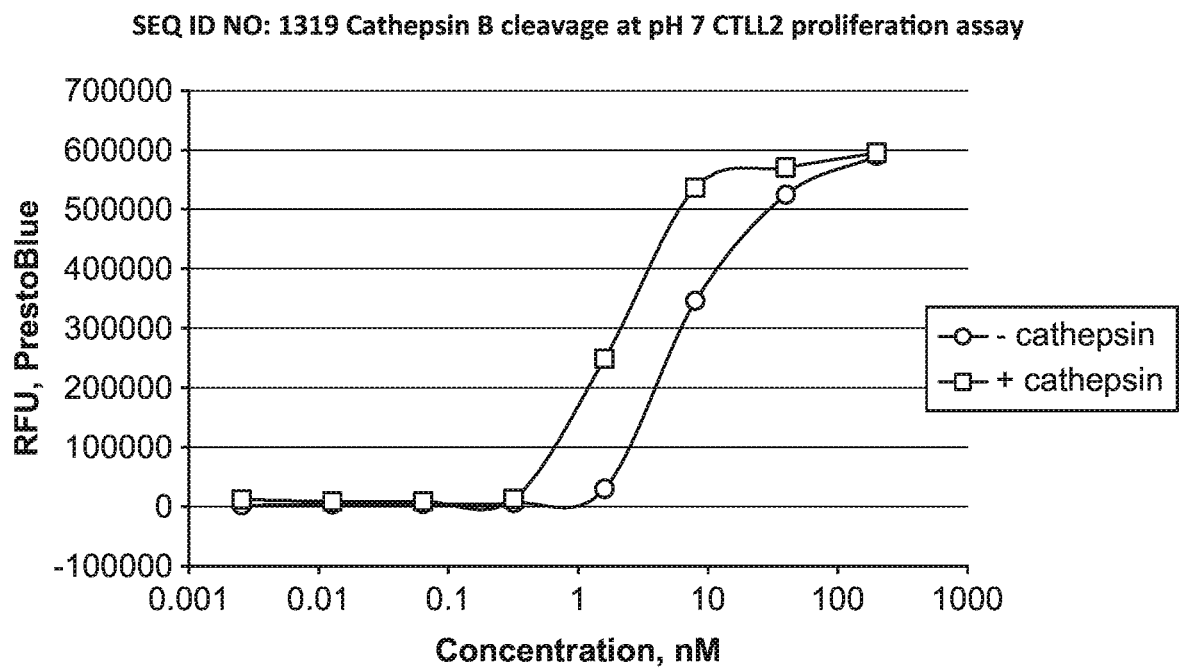
FIG. 32A illustrates cytokine activity, after cathepsin B treatment at pH 7, SEQ ID NO: 1319 in CTLL2 cells. Each point on the curve shows an average of n=3 per group.

FIG. 32A illustrates cytokine activity, after cathepsin B treatment at pH 7, of SEQ ID NO: 1319 in CTLL2 cells. Each point on the curve shows an average of n=3 per group.

Figure 32B:
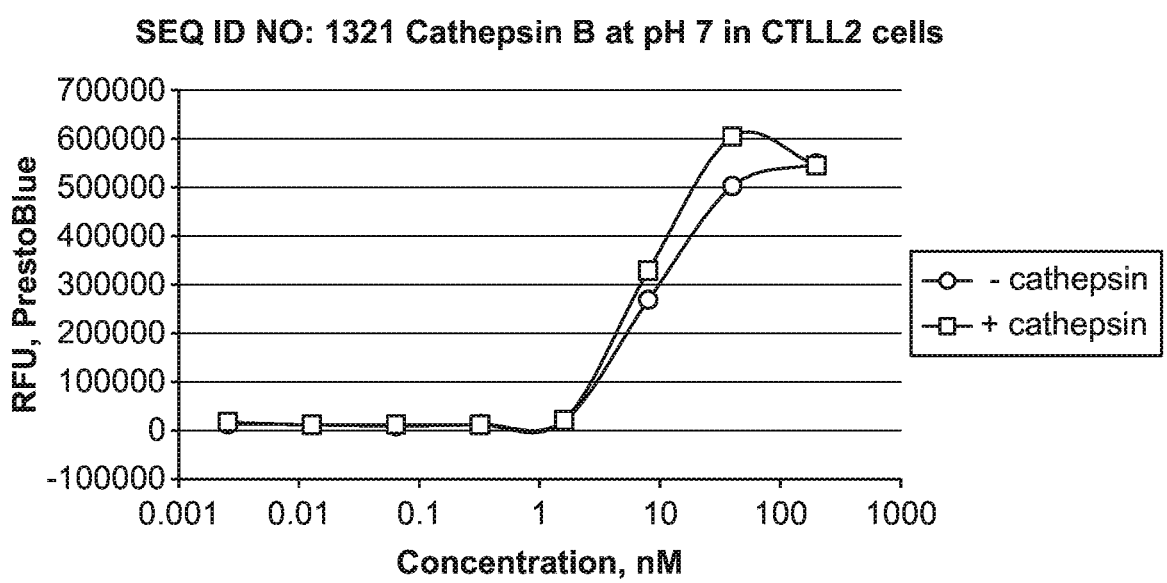
FIG. 32B illustrates cytokine activity, after cathepsin B treatment at pH 7, S SEQ ID NO: 1321 in CTLL2 cells. Each point on the curve shows an average of n=3 per group.
Figure 33:
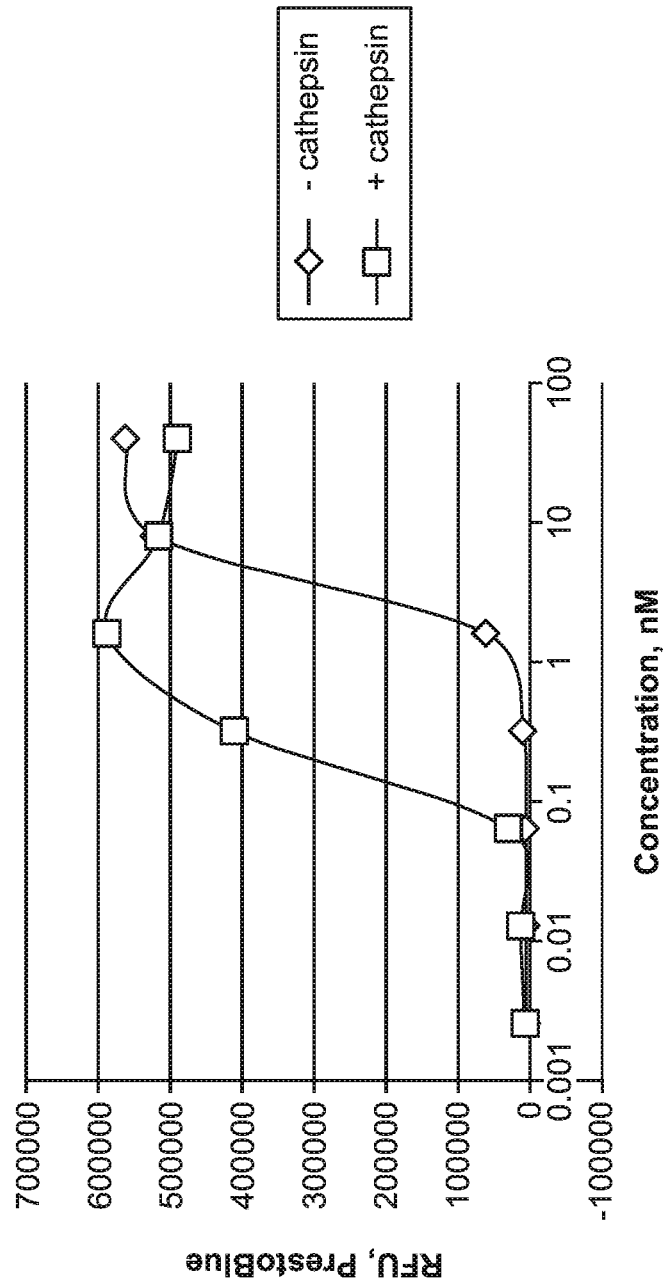
FIG. 33 illustrates cytokine activity, after cathepsin B treatment at pH 5, SEQ ID NO: 1317 in CTLL2 cells. Each point on the curve shows an average of n=3 per group.

FIG. 32B illustrates cytokine activity, after cathepsin B treatment at pH 7, of SEQ ID NO: 1321 in CTLL2 cells. Each point on the curve shows an average of n=3 per group. FIG. 32 demonstrates that cytokine activity is increased after cathepsin B cleavage at pH 7 in CTLL2 cells SEQ ID NO: 1319. FIG. 33 illustrates cytokine activity, after cathepsin B treatment at pH 5, of SEQ ID NO: 1317 in CTLL2 cells. Each point on the curve shows an average of n=3 per group. FIG. 33 demonstrates that cytokine activity is increased after cathepsin B cleavage at pH 5 (exopeptidase conditions) in CTLL2 cells for SEQ ID NO: 1317. Any peptide of the present disclosure can comprise a peptide-IL-15 agent complex with similar results, including any peptide of SEQ ID NO: 1, SEQ ID NO: 2, SEQ ID NO: 568, SEQ ID NO: 569 or SEQ ID NO: 570, or any peptide that is 80%, 85%, 90%, 95%, 96%, 97%, 98%, 99% or more identical to any of the foregoing Example 90

In Vitro Characterization of Tumor Cell Responses to Peptide-I/O Complexes

This example describes in vitro characterization of tumor cell responses to peptide-I/O complexes of the present disclosure. Cancer cells, such as human cancer cell lines or any of the mouse cancer cell lines used in syngeneic tumor models as described in EXAMPLES 36, 37, 45, are exposed to a peptide-I/O complex as described in EXAMPLES 36, 37, 38. The cells are incubated for a period of time sufficient to develop a response to the peptide-I/O complex; for example, 30 minutes, 1 hour, 4 hours, overnight, 24 hours, or 48 hours. A variety of responses are measured. The ability of cells to migrate is measured by scraping cells from an area of the culture dish, then measuring the change in width of the cleared area over time. Secreted proteins such as cytokines and growth factors are measured by standard methods such as ELISA. Changes in patterns of expression are measured at the protein level (proteomics analysis) or at the RNA level by microarray or RNA sequencing.

Example 91

In Vitro Characterization of Tumor Cell Interactions with Stroma and Endothelium This example describes in vitro characterization of tumor cell interactions with stroma and endothelium. Specifically, this example describes co-culture of cancer cells treated with a peptide-I/O complex of the present disclosure with stromal and/or vascular endothelial cells, in which the tumor cells are characterized for their ability to provoke inflammation or otherwise enhance the pro-tumor environment, to invade stroma, and/or to extravasate through vascular endothelium. Cancer cells, such as human cancer cell lines or any of the mouse cancer cell lines used in syngeneic tumor models as described in EXAMPLES 36, 37, 45, are exposed to a peptide-I/O complex as described in EXAMPLES 36, 37, 38. The cells are incubated for a period of time sufficient to develop a response to the peptide-I/O complex; for example, 30 minutes, 1 hour, 4 hours, overnight, 24 hours, or 48 hours. The media is removed and cells are washed to remove any remaining peptide-I/O complex. Control cell cultures are maintained in media without the peptide-I/O complex, but are otherwise treated identically. For some experiments, the peptide-I/O complex is added directly to the co-cultures. For some experiments, the cancer cells may be labeled with CFSE or other fluorescent marker. Stromal cells, such as fibroblasts, are plated directly or suspended in a gel such as Matrigel. Vascular endothelial cells are plated directly or grown in plates such as Transwell plates where two cultures are separated by a porous membrane. Cancer cells are cultured directly with the stromal cells or vascular endothelial cells, or are cultured in a Transwell type plate either in the same chamber or in the chamber opposite the stromal or vascular endothelial cells. After incubation for a period of time sufficient to develop a response, for example 30 minutes, 1 hour, 4 hours, overnight, 24 hours, 48 hours, or up to a week, the cultures are analyzed. Secreted growth factors and cytokines are measured by standard methods such as ELISA. The number and location of cancer cells is determined by counting the fluorescence labeled cells that have infiltrated the Matrigel or have migrated to or through the vascular endothelial cell layer. Reduction in stromal or matrix invasion, reduction in migration to or through vascular endothelium, and/or reduction in growth factors and cytokines that promote tumor cell growth and/or inhibit apoptosis in cultures with peptide-I/O complex treated cancer cells compared to control cell cultures indicates that the cancer cells have reduced invasion or metastasis properties on exposure to the peptide-I/O complex.

Example 92

Activation of RIG-I, MDA5, TLR3, or STING Pathways In Vitro

This example describes activation of RIG-I, MDA5, TLR3, or STING pathways in vitro. A peptide of this disclosure is complexed with an agent that can activate the RIG-I, the MDA5, the TLR3, or the STING pathway. Complexation can be by conjugating the peptide to the agent such as using the methods of EXAMPLE 16 or 17. Peptide-I/O conjugates such as the agents in FIGS. 13, 34, 37 are optionally used. A peptide of this disclosure is conjugated to ligands that stimulate related targets in the cell that will also trigger the SEAP reporter via IRF3 signaling as described in EXAMPLE 82. In particular, a peptide of the present disclosure is conjugated with a RIG-I ligand with 5' diphosphate, at least 10 base pairs, blunt 5' end, a greater than 12 base pair dsRNA (no 5'phosphates) to trigger MDA5, such as poly(I:C) or long poly (I:C)>50 bp dsRNA to trigger TLR3, Cyclic dinucleotide ligand for STING, or CPG for TLR9. The peptide-I/O complex is applied to cells shown to trigger the SEAP report via IRF3 as described in EXAMPLE 82.

Example 93

Effect of Peptide-IL-15 Agent Complexes on Immune Cell Populations

This example describes the effect of peptide-IL-15 agent complexes on immune cell populations. A peptide-I/O agent complex that comprises an IL-15 agent as the I/O can activate immune cells in different ways depending on factors such as inclusion of portions of the IL-15Rα chain in the peptide-I/O agent complex. Differences in the expression and composition of the IL-15R, and in particular the IL-15Rα chain occur among immune cells. Naive T cells express little or no IL-15Rα, while memory and effector T cells express high levels. IL-15 promotes CD4 T cell expansion, but significantly less than the expansion of NK cells and CD8 T cells, especially CD8 effector memory cells (Conlon 2015, Romee 2018). The expression of IL-15Rα, along with the IL-2Rβγ chains, endows cells with a much higher sensitivity to IL-15 (Dubois 2002). The prediction is that, due to the differential expression of IL-15Ra, naked IL-15 will stimulate mature T cells (IL-15Rα+) more effectively than naive cells (IL-15Rα−), but that an fusion IL-15 agent that contains IL-15 and IL-15Rα (such as sushi+) will stimulate both equally. This is a valuable property of a hyperagonist that can enhance anti-tumor immunity. The absence of Treg expansion is also a valuable criteria.

The potency of IL-15 and of peptide-IL-15-IL-15Ra (IL-15 fusion) complexes, such as described in EXAMPLE 18, on human leukocyte subsets is tested in vitro on normal human PBMC. Cells are with CFSE, as described in Kermer et al. (Mol Cancer Ther. 2012 June; 11(6):1279-1288), and cultured with various concentrations of IL-15 or the Peptide-IL-15-IL-15Ra complexes. After 5 days, the cells are harvested and analyzed by flow cytometry for their CFSE content and expression of T cell and NK cell surface markers. Markers may include CD3, CD4, CD8, CD56, CD16, Ki67, CD45 (RA and RO), NKG2D, CD127, CCR7, CC27, CD95, NKp30, TIM-3, and CD107a. The peptide-IL-15-IL-15Ra (IL-15 fusion) complexes stimulate particular subsets of these cells, especially CD4, CD8, γδT, Tregs, and NK cells, at lower concentrations than naked IL-15. CD4 T cells are expected to expand less than the CD8 or NK cells, based on the published clinical trial results (Conlon 2015, Romee 2018).

Example 94

Determining Trafficking and Compartment in which Peptide-I/O Complexes Enter a Cell This example describes determining trafficking and the compartment in which peptide-I/O complexes disclosed herein enter a cell. The compartment where a peptide-I/O complex that is a peptide-RIG-I ligand complex enters the cytoplasm is studied with pharmacological inhibitors of endosomal maturation and acidification. Pharmacological inhibitors of endosomal maturation and acidification include Bafilomycin, which is an inhibitor of endosomal acidification (blocking of the SEAP reporter by this agent will indicate that endosome acidification is critical), Wortmannin, which prevents maturation of EE to late endosomes, Brefeldin A, an inhibitor of trafficking of the EE to the Golgi and ER, or Nocodazole, an inhibitor of microtubule polymerization which disrupts early endosome to late endosome trafficking but not transport from the plasma membrane to early endosomes (Gao 2016).

The ability of peptide-RIG-I ligand I/O complexes to activate IRF3 in the presence of the above agents is tested by the methods of EXAMPLE 36. The pattern of SEAP reporter activation in the presence of these inhibitors provides insights into the precise compartment where cytoplasmic penetration occurs.

Example 95

Peptide Variants for Improved Cellular Penetration

This example describes peptide variants for improved cellular penetration. Variants of the peptides of this disclosure are created with higher levels of cellular penetration, endosomal release, or cytoplasmic delivery. Kim et al (2016) identified a mAb (TMab4) that has cytosol penetrating activity. The pH dependent translocation event seen for TMab4 requires the protonation of acidic Glu (E) or Asp (D) residues that leads to the availability of hydrophobic interactions with the endosomal membrane. Peptides such as SEQ ID NO: 569 has 3 acidic D residues, which can occur in the alpha helix and pH dependence of cytoplasmic penetration may involve these residues. Substitution of these D residues with E residues, or adding additional E residues is tested for effects on cytoplasmic delivery. Testing is performed by complexing such a peptide with a RIG-I ligand and performing the SEAP assay described in example 36. SEQ ID NO: 568 has three Arg (R) and three Lys (K) residues. Such basic residues are common in cationic amphipathic alpha helices (TAT, R8 (SEQ ID NO: 1385), Melitin) that have cell penetration properties. These residues are pH responsive, losing their positive charge in the acidic endosomal compartment. The role of these residues in cytoplasmic delivery of SEQ ID NO: 568 is evaluated by substitution, removing the K and R residues, or adding more R or K residues, forming a complex with RIG-I, and testing for IRF3 activation by the methods in example 36. Examination of the secondary structure of SEQ ID NO: 569 reveals beta sheet as well as alpha helix components. These structures determine functional domains such as cell penetration or ligand binding. Alteration of key residues in these domains, such as those mentioned above, can be tested for effects on peptide dissociation from Annexin A2 in the endosome (trafficking), and on cytoplasmic penetration (SEAP reporter activation). By these methods, peptides with even higher levels of delivery to cells are identified for use in peptide-I/O complexes.

Any peptide of the present disclosure can comprise a peptide-I/O agent complex with similar cell penetration results, including any peptide of SEQ ID NO: 1, SEQ ID NO: 2, SEQ ID NO: 568, SEQ ID NO: 569 or SEQ ID NO: 570, or any peptide that is 80%, 85%, 90%, 95%, 96%, 97%, 98%, 99% or more identical to any of the foregoing Example 96

Trafficking of Peptide-IL-15 Complexes

By attaching a peptide of this disclosure to an IL-15 I/O, the subcellular trafficking of the IL-15 I/O is changed. The peptide can cause increase endosomal uptake of the IL-15 I/O, and can also cause it to be recycled back to the cell surface and secreted, whereas an IL-15 I/O without the peptide maybe taken up by cells, at lower levels and may be trafficking for lysosomal degradation.

CT26 or U87 cells are exposed to peptide-IL-15 agent complexes, such as those of example 18, and then imaged with immunocytochemistry. Poly-lysine coated microscopy slides are used to construct chambers. 20,000 CT26 cells per well are plated and allowed to attach overnight. Media is aspirated and the cells are incubated with 10 uM of SEQ ID NO: 1317-SEQ ID NO: 1321, an RLI, or no agent for 1, 2, 3, 4, 8, or 24 hours. The cells are then washed with PBS, fixed with 10% neutral buffered formalin for 15 min, and washed with PBS. Wells are then washed with 0.1% TBST, incubated with 0.1% TBST+10% goat serum for 45 min, and then the solution is removed. Primary antibody mix is added to the wells for 60 min at room temp, then removed and the wells are washed with 0.1% TBST. Then solution is removed and fluorescent secondary antibody solution containing 0.01% TBST, 1% goat serum, DAPI stain, and Phalloidin stain, and an appropriate dilution of Alexafluor secondary antibody are added for 45 min at room temp. The wells are washed with 0.01% TBST and allowed to air dry, then coverslipped and allowed to dry in the dark. Wells are then imaged, for instance with 20× whole slide scanners, 60× oil immersion microscope, confocal microscope (z-stack setting 0.45 microns between slices), or Deltavision microscope with z-stack setting of 0.2 microns, and then deconvoluted with algorithms as appropriate.

Stains are for Rab 5 (early endosome), Rab7 (late endosome), Rab 11 (recycling endosome), and lysotracker555 (lysosome), as well as anti-His to identify the peptide-IL-15-I/O complex containing a His tag. The peptide-IL-15 complexes are shown to have higher cellular uptake, higher levels in Rab 5 and/or Rab 11 endosomes, than an RLI protein (comprising SEQ ID NO: 1169, SEQ ID No 1176, and SEQ ID No 1177) as A His-tagged RLI protein (SEQ ID NO: 1342), which has lower levels of uptake and may also have trafficking to the lysosome. Other peptide-I/O complexes can similarly exhibit uptake, such as peptide-IL-15 agent complexes containing an IL-15 agent such as $L_0$-X-$L_1$-Y-$L_2$, wherein $L_1$ can be SEQ ID NO: 1169 or SEQ ID NO: 1163, X can be SEQ ID NO: 1176 or SEQ ID NO: 1179, and Y can be SEQ ID NO: 1177, SEQ ID NO: 1178, in any combination. In addition, peptide-IL-15 agent complexes can comprise any of the complexes of TABLE 4.

The same experiment is performed with U87 glioma cells and similar trafficking of peptide-IL-15 complexes with higher cellular uptake, higher levels in Rab 5 or Rab 11 endosomes than IL-15 agents along is observed.

Flow cytometry is also used to demonstrate display of an IL-15 I/O on the surface of cells by delivery as a peptide-IL-15 I/O complex. Cancer cells such as U87, CT26, or B16F10 are exposed to the peptide-IL-15 I/O complex for 0.05, 0.5, 1, 2, 4, or 24 hours. The cells are then labeled with antibodies to IL-15 or to IL-15Rα and analyzed by flow cytometry. The analysis shows that the IL-15 is displayed on the surface of the cancer cells.

Any peptide of the present disclosure can comprise a peptide-IL-15 agent complex with similar trafficking results, including any peptide of SEQ ID NO: 1, SEQ ID NO: 2, SEQ ID NO: 568, SEQ ID NO: 569 or SEQ ID NO: 570, or any peptide that is 80%, 85%, 90%, 95%, 96%, 97%, 98%, 99% or more identical to any of the foregoing.

Example 97

Peptide-IL-15 Agent Complex Accumulation in Tumors

This example describes peptide-IL-15 agent complex accumulation in tumors. Peptide-IL-15 agent complexes such as this in example 18 were expressed and purified. Mice were dosed with 0.2 million CT26 cells, which were allowed to grow for 5 days, at which time tumors were palpable. Mice were dosed with 1-12 ug of SEQ ID NO: 1317, SEQ ID NO: 1321, an RLI, or no agent in 100 µl 4 days a week intraperitoneally. The treatments were well tolerated. After 7 doses, the animals were sacrificed and the tumor tissue was harvested and fixed.

The sections are stained by immunohistochemistry with antibodies to His tag, to IL-15, or to IL-15 sushi+. Higher signal is seen in tumors of mice treated with SEQ ID NO: 1317, SEQ ID NO: 1321 versus treated with an RLI, confirming that attaching a peptide of this disclosure increased the accumulation of the I/O complexes in the tumor.

Any peptide of the present disclosure can comprise a peptide-IL-15 agent complex with similar tumor accumulation, including any peptide of SEQ ID NO: 1, SEQ ID NO: 2, SEQ ID NO: 568, SEQ ID NO: 569 or SEQ ID NO: 570, or any peptide that is 80%, 85%, 90%, 95%, 96%, 97%, 98%, 99% or more identical to any of the foregoing.

Other peptide-I/O complexes can similarly exhibit uptake, such peptide-IL-15 agent complexes containing an IL-15 agent such as $L_0$-X-$L_1$-Y-$L_2$ wherein $L_1$ can be SEQ ID NO: 1169 or SEQ ID NO: 1163, X can be SEQ ID NO: 1176 or SEQ ID NO: 1179, and Y can be SEQ ID NO: 1177, SEQ ID NO: 1178, in any combination. In addition, peptide-IL-15 agent complexes can comprise any of the complexes of TABLE 4.

Example 98

Increase of Cellular Penetration of Peptide-I/O Complex, Particularly for Rig-I, MDA5, STING This example describes increase of cellular penetration of peptide-I/O complex, particularly for Rig-I, MDA5, STING. The level of cell penetration of an I/O of this disclosure in increased by adding additional cell penetrating moieties to a peptide-I/O complex of this disclosure. Optionally one or more peptides such as the peptides of TABLE 2 are complexed to the peptide-I/O complex. Optionally, a peptide of TABLE 2 is fused or conjugated to the peptide of TABLE 1. Optionally, a peptide of TABLE 2 is placed within the linker between the peptide of TABLE 1 and the I/O. Optionally one or more hydrophobic domains, such as lipids, fatty acids, cholesterol, lithocholic acid, lauric acid, docosahexaenoic acid, docosanoic acid, (CH2)x where x=1-40, is complexed to the peptide-I/O complex. Optionally, the hydrophobic domain is placed complexed to the peptide of TABLE 1 or to the I/O. Optionally the hydrophobic domain is placed within the linker between the peptide of TABLE 1 and the I/O. Optionally, the linker between the peptide of TABLE 1and the I/O is trifunctional, with one end linked to the peptide TABLE 1, one end linked to the I/O, and one end that is linked to a moiety that increases cell penetration of the complex, such as a peptide of TABLE 2 or a hydrophobic domain.

The I/O, either as a processed or cleaved I/O complex, or as the peptide-I/O complex itself has increased delivery into any part of the cell, including the cytoplasm, the endosomes, or other subcellular compartments and/or optionally has increased cellular uptake or endosomal escape.

Any peptide of the present disclosure can comprise a peptide-I/O complex with similar cell penetration results, including any peptide of SEQ ID NO: 1, SEQ ID NO: 2, SEQ ID NO: 568, SEQ ID NO: 569 or SEQ ID NO: 570, or any peptide that is 80%, 85%, 90%, 95%, 96%, 97%, 98%, 99% or more identical to any of the foregoing.

Example 99

Confirmation of Activation of Rig-I Pathway

The targeting of the Rig-I or MDA5 pathway by a particular peptide-I/O complex can be confirmed by the use of one or more reporter cell lines that have gene encoding the Rig-I or MDA5 either deleted or knocked out to enable testing of the targeting one or the other pathway as desired. Cell lines that can be used to directly confirm the requirement of Rig-I or MDA5 include the A549-Dual cells and the corresponding cells with Rig-I or MDA5 knocked out, A549-Dual KO-Rig-I and A549-Dual KO-MDA5. The reliance on the relevant RLRs for the response to a peptide-I/O complex can be further established using the A549-Dual KO-MAVS cell line. There may be peptide-I/O complexes that engage Rig-I or MDA5 in an unexpected way, for example, both receptors may be engaged, or there may be a biased ligand that engages a particular downstream signaling pathway, but not another. Rig-I stimulates transcription via the Type I IFN pathway using ISRE as well as through the NFκB promoter which regulate expression of different and overlapping sets of genes. MAVS also contributes to transcription of these genes, and in addition, may further engage the inflammasome that activates caspase 1 leading to activation and secretion of additional inflammatory molecules such as IL-1beta and IL-18. These cell lines can be used to assess the pathways sued by a particular peptide-I/O complex.

The peptide-Rig-I ligand complexes can also be tested on primary human cells to ensure that the Rig-I ligands of the disclosure are able to induce Rig-I mediated responses. Peripheral blood monocytes and dendritic cells are particularly interesting as they produce IL-1b which depends on inflammasome activation. This Rig-I pathway is independent of the IRF3 and NFkB pathways that are analyzed in the A549-Dual cell lines, and can be used to further substantiate the results of the A549-Dual cell lines. Tumor cells of different origins will also be tested, and their expression of Rig-I and MDA5 will be tested along with their responses to the Rig-I peptide-I/O complexes.

This example further describes confirmation of activation of RIG-I pathway. To confirm that the peptide-RIG-I ligand complex activates RIG-I specifically, rather than a related receptor such as MDA5, cell that do not express RIG-I can be treated with the complex and their responses compared with similar cells that do express RIG-I. Variants of the human lung carcinoma cell line A549 are used for this experiment. A549-Dual™ KO-RIG-I Cells (InvivoGen) were generated from the parent cell line (A549-Dual™) through stable knockout of the RIG-I gene. They do not express any RIG-I protein, but other pathway components are intact. The cell line carries reporter constructs to enable direct measurement of stimulation through the RIG-I pathway as well as the related NF-kB pathway.

A549-Dual KO-RIG-I and A549-Dual cells are treated with the peptide-RIG-I ligand complex. Media are collected at various time points, and the level of secreted luciferase driven by the reporter construct is measured using a reagent such as QUANTI-Luc (InvivoGen) and read on a luminometer. The relative light units (RLU) are proportional to the amount of luciferase secreted in response to the peptide-RIG-I complex. Reduced or absent luciferase secretion in the A549-Dual KO-RIG-I compared with the A549-Dual cells demonstrates that RIG-I is required for activity. This shows that the peptide-RIG-I complex directly activates RIG-I.

Any peptide of the present disclosure can comprise a peptide-RigI ligand complex with similar activation of the RigI pathway, including any peptide of SEQ ID NO: 1, SEQ ID NO: 2, SEQ ID NO: 568, SEQ ID NO: 569 or SEQ ID NO: 570, or any peptide that is 80%, 85%, 90%, 95%, 96%, 97%, 98%, 99% or more identical to any of the foregoing.

Example 100

In Vitro Activation of Peptide-IL-15 Agent Complexes by Tumor Cells

This example describes in vitro activation of peptide-IL-15 agent complexes by tumor cells.

Condition Media.

Cancer cells, such as human or mouse cancer cell lines are exposed to a peptide-IL-15 agent complex. The cancer cells are incubated for a period of time sufficient to bind, internalize, and develop a response to the peptide-IL-15 agent complex; for example, 30 minutes, 1 hour, 2 hours, 4 hours, 8 hours, overnight, 24 hours, or 48 hours. After the designated time, the media containing the peptide-IL-15 agent complex is removed and the cells are washed to remove residual test agent. Growth media is added to the cells and placed in the tissue culture incubator for a sufficient period of time for the cells to develop a response such as to secrete processed peptide-IL-15 agent molecules into the media, for example, 1 hour, 2 hours, 4 hours, 8 hours, overnight, 24 hours. The conditioned media is then removed and tested for cytokine activity in proliferation assays using cytokine dependent cell lines; for example Mole (human megakaryoblastic leukemia cell line), CTLL2 (mouse cytotoxic T lymphocyte cell line), primary human CD8+ T cells, or CD8+ T cell PHA induced blasts. The conditioned media induces a proliferation response in the cytokine dependent cell lines.

Co-Culture.

Cancer cells, such as human or mouse cancer cell lines are exposed to a peptide-IL-15 agent complex. The cancer cells are incubated for a period of time sufficient to bind, internalize, and develop a response to the peptide-IL-15 agent complex; for example, 30 minutes, 1 hour, 2 hours, 4 hours, 8 hours, overnight, 24 hours, or 48 hours. After the designated time, the media containing the peptide-IL-15 agent complex is removed and the cells are washed to remove residual test agent. A tissue culture insert that contains a semi-permeable membrane is added to the wells containing the adherent cancer cells. A cytokine dependent cell line, for example Mole (human megakaryoblastic leukemia cell line) or CTLL2 (mouse cytotoxic T lymphocyte cell line) will be place on the other side of the membrane. The semi-permeable membrane will allow passive diffusion of culture media, and products secreted by the cells without allowing the cells to come in direct contact. The only source of cytokine is secreted from the cancer cells; for example processed and/or secreted peptide I/O complex. The co-culture will be returned to the tissue culture incubator for a sufficient period of time for the cytokine dependent cells to develop a response; for example 2 hours, 4 hours, 8 hours, overnight, 24 hours, 48 hours, or 72 hours. The cytokine dependent cells are then assayed for proliferation using a viable cell assay such as PrestoBlue. The cytokine dependent cells show proliferation.

Any peptide of the present disclosure can comprise a peptide-IL-15 agent complex with similar activation of tumor cells, including any peptide of SEQ ID NO: 1, SEQ ID NO: 2, SEQ ID NO: 568, SEQ ID NO: 569 or SEQ ID NO: 570, or any peptide that is 80%, 85%, 90%, 95%, 96%, 97%, 98%, 99% or more identical to any of the foregoing.

Example 101

Induction of Abscopal Anti-Tumor Immunity by Rig-I- or MDA5-Ligand Peptide-I/O Complexes The induction of T cell mediated anti-tumor immunity results in the appearance of T cells capable of systemic action. Such T cells would be expected to function in the elimination of a primary tumor, and in addition, the eradication of subsequent metastases of the primary tumor at distal sites. Such T cells are also expected to give rise to memory T cells that will function after the disappearance of primary tumor to eradicate any relapse tumor.

The first model showing abscopal effects is the use of tumor vaccination, in which tumor cells are treated in vitro with a drug, and subsequently inoculated into mice (Fend 2017). The mice are subsequently challenged with live tumor. If the mice were pretreated with an inducer of anti-tumor T cells, then those mice will resist tumor progression. In this model, tumor cells, such as MCA205, CT26, 4T1, or others are treated in vitro with a Rig-I ligand peptide-I/O complex to induce those cells, possibly to apoptosis. The treated cells are then inoculated into mice in the flank subcutaneously. The mice are then challenged with the same tumor, untreated, at any time following the initial inoculation, for example 4 days later in the contralateral flank. The progression of tumor is then monitored at both the ipsilateral and contralateral sites. The tumor does not grow at the ipsilateral site, and there is a significant delay in tumor progression at the contralateral site.

Another model to demonstrate the role of anti-tumor T cells is the use of a tumor rechallenge for mice that survive an anti-tumor treatment (Jacobsen 2018). Surviving mice that have a memory T cell response to tumor will survive a second challenge with tumor. Such T cell memory can occur following tumor treatment with particular chemotherapies, radiotherapy, or treatments with certain biologicals, such as ligands of Rig-I. Mice harboring tumors are treated with a Rig-I ligand peptide-I/O complex. The tumors regress and the mice survive. The mice are then challenged with cells from the same tumor type again. The mice survive the second challenge.

Another model is the treatment of tumors in mice by intratumoral administration of drugs, followed by the evaluation of regression of contralateral untreated tumors in the same animal (Sagiv-Barfi 2015). Two tumors of the same kind are induced in a mouse, such as one in the right flank and one in the left flank. One tumor, such as that in the right flank, is injected intratumorally with a Rig-I ligand peptide-I/O complex. The other tumor, such as that in the left flank, regresses.

Any peptide of the present disclosure can comprise a peptide-RIG-I ligand complex with similar activation of tumor cells, including any peptide of SEQ ID NO: 1, SEQ ID NO: 2, SEQ ID NO: 568, SEQ ID NO: 569 or SEQ ID NO: 570, or any peptide that is 80%, 85%, 90%, 95%, 96%, 97%, 98%, 99% or more identical to any of the foregoing.

While certain embodiments of the present disclosure have been exemplified or shown and described herein, it will be apparent to those skilled in the art that such embodiments are provided by way of example only. It is not intended that the disclosure be limited by the specific examples provided within the specification. While the disclosure has been described with reference to the aforementioned specification, the descriptions and illustrations of the embodiments herein are not meant to be construed in a limiting sense. Numerous variations, changes, and substitutions will now occur to those skilled in the art without departing from the disclosure. Furthermore, it shall be understood that all embodiments of the disclosure are not limited to the specific depictions, configurations or relative proportions set forth herein which depend upon a variety of conditions and variables. It should be understood that various alternatives to the embodiments of the disclosure described herein can be employed in practicing the disclosure. It is therefore contemplated that the disclosure shall also cover any such alternatives, modifications, variations or equivalents. It is intended that the following claims define the scope of the disclosure and that methods and structures within the scope of these claims and their equivalents be covered thereby.

SEQUENCE LISTING (1518 sequences)

SEQ ID NO: 1 - protein, 38 aa, Artificial Sequence
  Description of Artificial Sequence: Synthetic polypeptide
GSMCMPCFTTDHQMARKCDDCCGGKGRGKCYGPQCLCR

SEQ ID NO: 2 - protein, 38 aa, Artificial Sequence
  Description of Artificial Sequence: Synthetic polypeptide
GSMCMPCFTTDHQMARRCDDCCGGRGRGKCYGPQCLCR

SEQ ID NO: 3 - protein, 38 aa, Artificial Sequence
  Description of Artificial Sequence: Synthetic polypeptide
GSMCMPCFTTDHQMARRCDDCCGGRGRGRCYGPQCLCR

SEQ ID NO: 4 - protein, 38 aa, Artificial Sequence
  Description of Artificial Sequence: Synthetic polypeptide
GSMCMPCFTTDHQMARKCDDCCGGRGRGRCYGPQCLCR

SEQ ID NO: 5 - protein, 38 aa, Artificial Sequence
  Description of Artificial Sequence: Synthetic polypeptide
GSMCMPCFTTDHQMARRCDDCCGGKGRGRCYGPQCLCR

SEQ ID NO: 6 - protein, 38 aa, Artificial Sequence
  Description of Artificial Sequence: Synthetic polypeptide
GSMCMPCFTTHHRMAENCDICCGGDGRGKCYGPQCLCR

SEQ ID NO: 7 - protein, 38 aa, Artificial Sequence
  Description of Artificial Sequence: Synthetic polypeptide
GSMCMPCFTTDTQMQERCDRCCGGGGRGKCWGPQCLCI

SEQ ID NO: 8 - protein, 38 aa, Artificial Sequence
  Description of Artificial Sequence: Synthetic polypeptide
GSMCMPCFTTDTQMQERCDRCCGGGGRGRCWGPQCLCI

SEQ ID NO: 9 - protein, 38 aa, Artificial Sequence
  Description of Artificial Sequence: Synthetic polypeptide
GSMCMPCFTTEQRMAIICDDCCGGFGRGKCYGPQCLCR

SEQ ID NO: 10 - protein, 38 aa, Artificial Sequence
  Description of Artificial Sequence: Synthetic polypeptide
GSMCMPCFTTEQRMAIICDDCCGGFGRGRCYGPQCLCR

SEQ ID NO: 11 - protein, 38 aa, Artificial Sequence
  Description of Artificial Sequence: Synthetic polypeptide
GSICIPCFTTDHQIARRCDDCCGGRGRGKCYGPQCICR

SEQ ID NO: 12 - protein, 38 aa, Artificial Sequence
  Description of Artificial Sequence: Synthetic polypeptide
GSICIPCFTTDHQIARRCDDCCGGRGRGRCYGPQCICR

SEQ ID NO: 13 - protein, 38 aa, Artificial Sequence
  Description of Artificial Sequence: Synthetic polypeptide
GSMCMPCFTTDHRMAENCDICCGGDGRGKCYGPQCLCR

SEQ ID NO: 14 - protein, 38 aa, Artificial Sequence
  Description of Artificial Sequence: Synthetic polypeptide
GSMCMPCFTTDHRMAENCDICCGGDGRGRCYGPQCLCR

SEQ ID NO: 15 - protein, 38 aa, Artificial Sequence
  Description of Artificial Sequence: Synthetic polypeptide
GSMCMPCFTTEQRMAIICDDCCGGFGRGKCYGPQCLCI

SEQ ID NO: 16 - protein, 38 aa, Artificial Sequence
  Description of Artificial Sequence: Synthetic polypeptide
GSMCMPCFTTEQRMAIICDDCCGGFGRGRCYGPQCLCI

SEQ ID NO: 17 - protein, 38 aa, Artificial Sequence
  Description of Artificial Sequence: Synthetic polypeptide
GSICIPCFTTDHQIARRCDDCCGGRGRGKCYGPQCICI

SEQ ID NO: 18 - protein, 38 aa, Artificial Sequence
  Description of Artificial Sequence: Synthetic polypeptide
GSICIPCFTTDHQIARRCDDCCGGRGRGRCYGPQCICI

SEQ ID NO: 19 - protein, 38 aa, Artificial Sequence
  Description of Artificial Sequence: Synthetic polypeptide
GSMCMPCFTTDHRMAENCDICCGGDGRGKCYGPQCLCI

SEQ ID NO: 20 - protein, 38 aa, Artificial Sequence
  Description of Artificial Sequence: Synthetic polypeptide
GSMCMPCFTTDHRMAENCDICCGGDGRGRCYGPQCLCI

SEQ ID NO: 21 - protein, 38 aa, Artificial Sequence
  Description of Artificial Sequence: Synthetic polypeptide
GSMCMPCFTTDTQMQEKCDRCCGGGGRGRCWGPQCLCI

SEQ ID NO: 22 - protein, 38 aa, Artificial Sequence
  Description of Artificial Sequence: Synthetic polypeptide
GSMCMPCFTTEQRMAIKCDDCCGGFGRGRCYGPQCLCR

SEQ ID NO: 23 - protein, 38 aa, Artificial Sequence
  Description of Artificial Sequence: Synthetic polypeptide
GSICIPCFTTDHQIARKCDDCCGGRGRGRCYGPQCICR

SEQ ID NO: 24 - protein, 38 aa, Artificial Sequence
  Description of Artificial Sequence: Synthetic polypeptide
GSMCMPCFTTDHRMAEKCDICCGGDGRGRCYGPQCLCR

SEQ ID NO: 25 - protein, 38 aa, Artificial Sequence
  Description of Artificial Sequence: Synthetic polypeptide
GSMCMPCFTTDTQMQERCDRCCGGKGRGRCWGPQCLCI

SEQ ID NO: 26 - protein, 38 aa, Artificial Sequence
  Description of Artificial Sequence: Synthetic polypeptide
GSMCMPCFTTEQRMAIICDDCCGGKGRGRCYGPQCLCR

SEQ ID NO: 27 - protein, 38 aa, Artificial Sequence
  Description of Artificial Sequence: Synthetic polypeptide
GSICIPCFTTDHQIARRCDDCCGGKGRGRCYGPQCICR

SEQ ID NO: 28 - protein, 38 aa, Artificial Sequence
  Description of Artificial Sequence: Synthetic polypeptide
GSMCMPCFTTDHRMAENCDICCGGKGRGRCYGPQCLCR

SEQ ID NO: 29 - protein, 38 aa, Artificial Sequence
  Description of Artificial Sequence: Synthetic polypeptide
GSMCMPCFTTHHRMAENCDICCGGDGRGRCYGPQCLCR

SEQ ID NO: 30 - protein, 37 aa, Artificial Sequence
  Description of Artificial Sequence: Synthetic polypeptide
GSMCMPCFTTDTQMQERCDRCCGGGGRGRCWGPQCLC

SEQ ID NO: 31 - protein, 37 aa, Artificial Sequence
  Description of Artificial Sequence: Synthetic polypeptide
GSMCMPCFTTEQRMAIICDDCCGGFGRGRCYGPQCLC

SEQ ID NO: 32 - protein, 37 aa, Artificial Sequence
  Description of Artificial Sequence: Synthetic polypeptide
GSICIPCFTTDHQIARRCDDCCGGRGRGRCYGPQCIC

SEQ ID NO: 33 - protein, 37 aa, Artificial Sequence
  Description of Artificial Sequence: Synthetic polypeptide
GSMCMPCFTTDHRMAENCDICCGGDGRGRCYGPQCLC

SEQ ID NO: 34 - protein, 38 aa, Artificial Sequence
  Description of Artificial Sequence: Synthetic polypeptide
GSMCMPCFTTDHQMARRCDDCCGGRGRGRCYGPQCLCI

SEQ ID NO: 35 - protein, 38 aa, Artificial Sequence
  Description of Artificial Sequence: Synthetic polypeptide
GSACAPCFTTDHQAARRCDDCCGGRGRGKCYGPQCLCR

SEQ ID NO: 36 - protein, 38 aa, Artificial Sequence
  Description of Artificial Sequence: Synthetic polypeptide
GSACAPCFTTDHQAARKCDDCCGGKGRGKCYGPQCLCR

SEQ ID NO: 37 - protein, 38 aa, Artificial Sequence
  Description of Artificial Sequence: Synthetic polypeptide
GSMCMPCFTTHHRMAENCDICCGGDGRGKCYGPQCLCI

SEQ ID NO: 38 - protein, 37 aa, Artificial Sequence
  Description of Artificial Sequence: Synthetic polypeptide
GSMCMPCFTTHHRMAENCDICCGGDGRGKCYGPQCLC

SEQ ID NO: 39 - protein, 37 aa, Artificial Sequence
  Description of Artificial Sequence: Synthetic polypeptide
GSMCMPCFTTDHQMARRCDDCCGGRGRGRCYGPQCLC

SEQ ID NO: 40 - protein, 38 aa, Artificial Sequence
  Description of Artificial Sequence: Synthetic polypeptide
GSMCMPCFTTHHQMAENCDICCGGDGRGKCYGPQCLCR

SEQ ID NO: 41 - protein, 38 aa, Artificial Sequence
  Description of Artificial Sequence: Synthetic polypeptide
GSMCMPCFTTHHRMARNCDICCGGDGRGKCYGPQCLCR

SEQ ID NO: 42 - protein, 38 aa, Artificial Sequence
  Description of Artificial Sequence: Synthetic polypeptide
GSMCMPCFTTHHRMAERCDICCGGDGRGKCYGPQCLCR

SEQ ID NO: 43 - protein, 38 aa, Artificial Sequence
  Description of Artificial Sequence: Synthetic polypeptide
GSMCMPCFTTHHRMAENCDDCCGGDGRGKCYGPQCLCR

SEQ ID NO: 44 - protein, 38 aa, Artificial Sequence
  Description of Artificial Sequence: Synthetic polypeptide
GSRCMPCFTTDHQMARRCDDCCGGRGRGKCYGPQCLCR

SEQ ID NO: 45 - protein, 38 aa, Artificial Sequence
  Description of Artificial Sequence: Synthetic polypeptide
GSICIPCFTTDHQIARRCDDCCGGRGRGKCYGPQCLCR

SEQ ID NO: 46 - protein, 38 aa, Artificial Sequence
  Description of Artificial Sequence: Synthetic polypeptide
GSMCLPCFTTDHQLARRCDDCCGGRGRGKCYGPQCLCR

SEQ ID NO: 47 - protein, 38 aa, Artificial Sequence
  Description of Artificial Sequence: Synthetic polypeptide
GSMCMPCFTTEHQMARRCEECCGGRGRGKCYGPQCLCR

SEQ ID NO: 48 - protein, 38 aa, Artificial Sequence
  Description of Artificial Sequence: Synthetic polypeptide
GSMCIPCFTTDHQMARRCEECCGGRGRGKCYGPQCLCR

SEQ ID NO: 49 - protein, 38 aa, Artificial Sequence
  Description of Artificial Sequence: Synthetic polypeptide
GSICIPCFTTDHQMARRCDDCCGGRGDGKCYGPQCLCR

SEQ ID NO: 50 - protein, 38 aa, Artificial Sequence
  Description of Artificial Sequence: Synthetic polypeptide
GSRCMPCFTTDHFMARFCDFCCGGRGRGKCYGPQCLCR

SEQ ID NO: 51 - protein, 38 aa, Artificial Sequence
  Description of Artificial Sequence: Synthetic polypeptide
GSRCMPCFTTDHYMARYCDYCCGGRGRGKCYGPQCLCR

SEQ ID NO: 52 - protein, 38 aa, Artificial Sequence
  Description of Artificial Sequence: Synthetic polypeptide
GSRCMPCFTTDHRMARRCDRCCGGRGRGKCYGPQCLCR

SEQ ID NO: 53 - protein, 38 aa, Artificial Sequence
  Description of Artificial Sequence: Synthetic polypeptide
GSRCMPCFTTDHEMARECDECCGGRGRGKCYGPQCLCR

SEQ ID NO: 54 - protein, 38 aa, Artificial Sequence
  Description of Artificial Sequence: Synthetic polypeptide
GSRCMPCFTTDHHMARHCDHCCGGRGRGKCYGPQCLCR

SEQ ID NO: 55 - protein, 38 aa, Artificial Sequence
  Description of Artificial Sequence: Synthetic polypeptide
GSLCLPCFTTHHRLADQCDICCGGDGRGKCYGPQCLCR

SEQ ID NO: 56 - protein, 38 aa, Artificial Sequence
  Description of Artificial Sequence: Synthetic polypeptide
GSICIPCFTTEHQIARRCEECCGGRGRGKCYGPQCLCR

SEQ ID NO: 57 - protein, 38 aa, Artificial Sequence
  Description of Artificial Sequence: Synthetic polypeptide
GSMCMPCFTTIYRMAHECDECCGGRGRGKCYGPQCLCR

SEQ ID NO: 58 - protein, 38 aa, Artificial Sequence
  Description of Artificial Sequence: Synthetic polypeptide
GSMCMPCFTTGYRMAEYCDICCGGRGRGKCYGPQCLCR

SEQ ID NO: 59 - protein, 38 aa, Artificial Sequence
  Description of Artificial Sequence: Synthetic polypeptide
GSMCMPCFTTHRRMANTCDACCGGRSRGKCYGPQCLCR

SEQ ID NO: 60 - protein, 38 aa, Artificial Sequence
  Description of Artificial Sequence: Synthetic polypeptide
GSHCMPCFTTDHQMIRRCDDCCGGGSYGKCDGPQCLCF

SEQ ID NO: 61 - protein, 38 aa, Artificial Sequence
  Description of Artificial Sequence: Synthetic polypeptide
GSDCMPCFTTDHRMADHCDICCGGDDRGKCYGPQCLCR

SEQ ID NO: 62 - protein, 38 aa, Artificial Sequence
  Description of Artificial Sequence: Synthetic polypeptide
GSMCMPCFTTDHEMERRCDDCCGIGGGGKCHGPQCLCG

SEQ ID NO: 63 - protein, 38 aa, Artificial Sequence
  Description of Artificial Sequence: Synthetic polypeptide
GSMCMPCFTTSEQMFRRCDDCCGGWGDGKCNGPHCLCR

SEQ ID NO: 64 - protein, 36 aa, Artificial Sequence
  Description of Artificial Sequence: Synthetic polypeptide
GSCGPCFTTDHQMEQKCAECCGGIGKCYGPQCLCNR

SEQ ID NO: 65 - protein, 40 aa, Artificial Sequence
  Description of Artificial Sequence: Synthetic polypeptide
GSRCGPCFTTDPQTQAKCSECCGRKGGVCKGPQCICGIQY

SEQ ID NO: 66 - protein, 37 aa, Artificial Sequence
  Description of Artificial Sequence: Synthetic polypeptide
GSMCMPCFTTDPNMAKKCRDCCGGNGKCFGPQCLCNR

SEQ ID NO: 67 - protein, 36 aa, Artificial Sequence
  Description of Artificial Sequence: Synthetic polypeptide
GSMCMPCFTTDHNMAKKCNDCCGGYGKCFGPQCLCR

SEQ ID NO: 68 - protein, 38 aa, Artificial Sequence
  Description of Artificial Sequence: Synthetic polypeptide
GSRCPPCFTTNPNMEADCRKCCGGRGYCASYQCICPGG

SEQ ID NO: 69 - protein, 37 aa, Artificial Sequence
  Description of Artificial Sequence: Synthetic polypeptide
GSMCMPCFTTDPNMANKCRDCCGGGKKCFGPQCLCNR

SEQ ID NO: 70 - protein, 64 aa, Artificial Sequence
  Description of Artificial Sequence: Synthetic polypeptide
GSMKFLYGVILIALFLTVMTATLSEARCGPCFTTDPQTQAKCSECCGRKGGVCKGPQCICGIQY

SEQ ID NO: 71 - protein, 38 aa, Artificial Sequence
  Description of Artificial Sequence: Synthetic polypeptide
GSMCMPCFTTRPDMAQQCRACCKGRGKCFGPQCLCGYD

SEQ ID NO: 72 - protein, 62 aa, Artificial Sequence
  Description of Artificial Sequence: Synthetic polypeptide
GSMKFLYGIVFIALFLTVMTATLSDAMCMPCFTTDHNMAKKCRDCCGGNGKCFGPQCLCNRG

SEQ ID NO: 73 - protein, 37 aa, Artificial Sequence
  Description of Artificial Sequence: Synthetic polypeptide
GSMCMPCFTTDHNMAKKCRDCCGGNGKCFGPQCLCNR

SEQ ID NO: 74 - protein, 62 aa, Artificial Sequence
  Description of Artificial Sequence: Synthetic polypeptide
GSMKFLYGIVFITLFLTVMIATHTEAMCMPCFTTRPNMAQQCRDCCRGRGKCFGPQCLCGYD

SEQ ID NO: 75 - protein, 62 aa, Artificial Sequence
  Description of Artificial Sequence: Synthetic polypeptide
GSMKFLYGIVFIALFLTVMIATHTEAMCMPCFTTRPNMAQQCRDCCRGRGKCFGPQCLCGYD

SEQ ID NO: 76 - protein, 37 aa, Artificial Sequence
  Description of Artificial Sequence: Synthetic polypeptide
GSRCKPCFTTDPQMSKKCADCCGGKGKGKCYGPQCLC

SEQ ID NO: 77 - protein, 63 aa, Artificial Sequence
  Description of Artificial Sequence: Synthetic polypeptide
GSMKFLYGIVFITLFLTVMIATHTEAAMCMPCFTTNLNMEQECRDCCGGTGRCFGPQCLCGYD

SEQ ID NO: 78 - protein, 40 aa, Artificial Sequence
  Description of Artificial Sequence: Synthetic polypeptide
GSRCSPCFTTDQQMTKKCYDCCGGKGKGKCYGPQCICAPY

SEQ ID NO: 79 - protein, 37 aa, Artificial Sequence
  Description of Artificial Sequence: Synthetic polypeptide
GSCGPCFTTDPYTESKCATCCGGRGKCVGPQCLCNRI

SEQ ID NO: 80 - protein, 41 aa, Artificial Sequence
  Description of Artificial Sequence: Synthetic polypeptide
GSTEAMCMPCFTTDHNMAKKCRDCCGGNGKCFGYQCLCNRG

SEQ ID NO: 81 - protein, 61 aa, Artificial Sequence
  Description of Artificial Sequence: Synthetic polypeptide
GSMKFLYGIVFIALFLTVMFATQTDGCGPCFTTDANMARKCRECCGGIGKCFGPQCLCNRI

SEQ ID NO: 82 - protein, 61 aa, Artificial Sequence
  Description of Artificial Sequence: Synthetic polypeptide
GSMKFLYGIVFIALFLTVMFATQTDGCGPCFTTDANMARKCRECCGGNGKCFGPQCLCNRE

SEQ ID NO: 83 - protein, 62 aa, Artificial Sequence
  Description of Artificial Sequence: Synthetic polypeptide
GSMKFLYGTILIAFFLTVMIATHSEARCPPCFTTNPNMEADCRKCCGGRGYCASYQCICPGG

SEQ ID NO: 84 - protein, 41 aa, Artificial Sequence
  Description of Artificial Sequence: Synthetic polypeptide
GSTEAMCMPCFTTRPDMAQQCRDCCGGNGKCFGYQCLCNRG

SEQ ID NO: 85 - protein, 62 aa, Artificial Sequence
  Description of Artificial Sequence: Synthetic polypeptide
GSMKFLYGIVFIALFLTVMIATLTEAMCMPCFTTRPDMAQQCRDCCGGNGKCFGYQCLCNRG

SEQ ID NO: 86 - protein, 62 aa, Artificial Sequence
  Description of Artificial Sequence: Synthetic polypeptide
GSMKFLYGIVFIALFLTVMIATHTEAMCMPCFTTRPDMAQQCRDCCGGNGKCFGYQCLCNRG

SEQ ID NO: 87 - protein, 63 aa, Artificial Sequence
  Description of Artificial Sequence: Synthetic polypeptide
GSMKFLYGIILIALFLTVMIATHSEARCPNCFTTNPNAEADCKKCCGNRWGKCAGYQCVCPMK

SEQ ID NO: 88 - protein, 69 aa, Artificial Sequence
  Description of Artificial Sequence: Synthetic polypeptide
GSMKFLYGIVFIALFLTGMIATHTEAMCMPCFTTRPDMAQQCRDCCGGNGKCFGYQCLCNRGRIVIMYT

SEQ ID NO: 89 - protein, 37 aa, Artificial Sequence
  Description of Artificial Sequence: Synthetic polypeptide
GSMCMPCFTTRPGMAQQCRDCCGGNGKCFGYQCLCNR

SEQ ID NO: 90 - protein, 37 aa, Artificial Sequence
  Description of Artificial Sequence: Synthetic polypeptide
GSMCIPCFTTNPNMAAKCNACCGSRRGSCRGPQCICR

SEQ ID NO: 91 - protein, 37 aa, Artificial Sequence
  Description of Artificial Sequence: Synthetic polypeptide
GSMCIPCFTTNPNMAAKCNACCGSRRGSCRGPQCICN

SEQ ID NO: 92 - protein, 36 aa, Artificial Sequence
  Description of Artificial Sequence: Synthetic polypeptide
GSMCIPCFTTNPNMAAKCNACCGGNGSCRGPQCICN

SEQ ID NO: 93 - protein, 38 aa, Artificial Sequence
  Description of Artificial Sequence: Synthetic polypeptide
GSMCIPCFTTNPNMAAKCNACCGSRGRGSCRGPQCICN

SEQ ID NO: 94 - protein, 38 aa, Artificial Sequence
  Description of Artificial Sequence: Synthetic polypeptide
GSMCIPCFTTNPNMAAKCNACCGSRGRGKCRGPQCICN

SEQ ID NO: 95 - protein, 37 aa, Artificial Sequence
  Description of Artificial Sequence: Synthetic polypeptide
GSMCIPCFTTDHQMAAKCNACCGSRRGSCRGPQCICN

SEQ ID NO: 96 - protein, 37 aa, Artificial Sequence
  Description of Artificial Sequence: Synthetic polypeptide
GSMCIPCFTTNHQMAAKCNACCGSRRGSCRGPQCICN

SEQ ID NO: 97 - protein, 38 aa, Artificial Sequence
  Description of Artificial Sequence: Synthetic polypeptide
GSMCIPCFTTNPNMARKCNACCGSRGRGSCRGPQCICN

SEQ ID NO: 98 - protein, 38 aa, Artificial Sequence
  Description of Artificial Sequence: Synthetic polypeptide
GSMCIPCFTTNPNMAAKCNACCGGKGRGSCRGPQCICN

SEQ ID NO: 99 - protein, 37 aa, Artificial Sequence
  Description of Artificial Sequence: Synthetic polypeptide
GSMCIPCFTTNPNMAAKCNACCGSRRGSCFGPQCICN

SEQ ID NO: 100 - protein, 38 aa, Artificial Sequence
  Description of Artificial Sequence: Synthetic polypeptide
GSMCIPCFTTNPNMAAKCNACCGSRGRGKCFGPQCICN

SEQ ID NO: 101 - protein, 38 aa, Artificial Sequence
  Description of Artificial Sequence: Synthetic polypeptide
GSMCIPCFTTNPNMAAKCNACCGSRGRGSCFGPQCICN

SEQ ID NO: 102 - protein, 38 aa, Artificial Sequence
  Description of Artificial Sequence: Synthetic polypeptide
GSMCIPCFTTNPNMAAKCNACCGSRGRGSCYGPQCICN

SEQ ID NO: 103 - protein, 37 aa, Artificial Sequence
  Description of Artificial Sequence: Synthetic polypeptide
GSMCIPCFTTNPNMAAKCDACCGSRRGSCRGPQCICN

SEQ ID NO: 104 - protein, 37 aa, Artificial Sequence
  Description of Artificial Sequence: Synthetic polypeptide
GSMCIPCFTTNHQMAAKCDACCGSRRGSCRGPQCICN

SEQ ID NO: 105 - protein, 38 aa, Artificial Sequence
  Description of Artificial Sequence: Synthetic polypeptide
GSMCIPCFTTNHNMAAKCDACCGGRGRGSCRGPQCICN

SEQ ID NO: 106 - protein, 38 aa, Artificial Sequence
  Description of Artificial Sequence: Synthetic polypeptide
GSMCIPCFTTNPNMAAKCDACCGSRGRGSCRGPQCICN

SEQ ID NO: 107 - protein, 38 aa, Artificial Sequence
  Description of Artificial Sequence: Synthetic polypeptide
GSMCIPCFTTNPNMAAKCDACCGGKGRGSCRGPQCICN

SEQ ID NO: 108 - protein, 38 aa, Artificial Sequence
  Description of Artificial Sequence: Synthetic polypeptide
GSMCIPCFTTNHNMAAKCDACCGSRGRGSCRGPQCICN

SEQ ID NO: 109 - protein, 36 aa, Artificial Sequence
  Description of Artificial Sequence: Synthetic polypeptide
GSMCIPCFTTNPNMAAKCRDCCGGRGSCRGPQCICN

SEQ ID NO: 110 - protein, 38 aa, Artificial Sequence
  Description of Artificial Sequence: Synthetic polypeptide
GSMCMPCFTTNPNMAAKCDDCCGSRGRGSCRGPQCICN

SEQ ID NO: 111 - protein, 36 aa, Artificial Sequence
  Description of Artificial Sequence: Synthetic polypeptide
GSMCIPCFTTNPNMAARCNACCGSRRGSCRGPQCIC

SEQ ID NO: 112 - protein, 37 aa, Artificial Sequence
  Description of Artificial Sequence: Synthetic polypeptide
GSMCIPCFTTNPNMAAKCNACCGSRRGSCRGPQCICI

SEQ ID NO: 113 - protein, 38 aa, Artificial Sequence
  Description of Artificial Sequence: Synthetic polypeptide
GSMCMPCFTTDHQMARACDDCCGGKGRGKCYGPQCLCR

SEQ ID NO: 114 - protein, 38 aa, Artificial Sequence
  Description of Artificial Sequence: Synthetic polypeptide
GSMCMPCFTTDHQMARRCDDCCGGKGRGKCYGPQCLCR

SEQ ID NO: 115 - protein, 38 aa, Artificial Sequence
  Description of Artificial Sequence: Synthetic polypeptide
GSMCMPCFTTDHQMARKCDDCCGGAGRGKCYGPQCLCR

SEQ ID NO: 116 - protein, 38 aa, Artificial Sequence
  Description of Artificial Sequence: Synthetic polypeptide
GSMCMPCFTTDHQMARACDDCCGGAGRGKCYGPQCLCR

SEQ ID NO: 117 - protein, 38 aa, Artificial Sequence
  Description of Artificial Sequence: Synthetic polypeptide
GSMCMPCFTTDHQMARRCDDCCGGAGRGKCYGPQCLCR

SEQ ID NO: 118 - protein, 38 aa, Artificial Sequence
  Description of Artificial Sequence: Synthetic polypeptide
GSMCMPCFTTDHQMARKCDDCCGGRGRGKCYGPQCLCR

SEQ ID NO: 119 - protein, 38 aa, Artificial Sequence
  Description of Artificial Sequence: Synthetic polypeptide
GSMCMPCFTTDHQMARACDDCCGGRGRGKCYGPQCLCR

SEQ ID NO: 120 - protein, 38 aa, Artificial Sequence
  Description of Artificial Sequence: Synthetic polypeptide
GSMCMPCFTTDHQMARKCDDCCGGKGRGACYGPQCLCR

SEQ ID NO: 121 - protein, 38 aa, Artificial Sequence
  Description of Artificial Sequence: Synthetic polypeptide
GSMCMPCFTTDHQMARACDDCCGGKGRGACYGPQCLCR

SEQ ID NO: 122 - protein, 38 aa, Artificial Sequence
  Description of Artificial Sequence: Synthetic polypeptide
GSMCMPCFTTDHQMARRCDDCCGGKGRGACYGPQCLCR

SEQ ID NO: 123 - protein, 38 aa, Artificial Sequence
  Description of Artificial Sequence: Synthetic polypeptide
GSMCMPCFTTDHQMARKCDDCCGGAGRGACYGPQCLCR

SEQ ID NO: 124 - protein, 38 aa, Artificial Sequence
  Description of Artificial Sequence: Synthetic polypeptide
GSMCMPCFTTDHQMARACDDCCGGAGRGACYGPQCLCR

SEQ ID NO: 125 - protein, 38 aa, Artificial Sequence
  Description of Artificial Sequence: Synthetic polypeptide
GSMCMPCFTTDHQMARRCDDCCGGAGRGACYGPQCLCR

SEQ ID NO: 126 - protein, 38 aa, Artificial Sequence
  Description of Artificial Sequence: Synthetic polypeptide
GSMCMPCFTTDHQMARKCDDCCGGRGRGACYGPQCLCR

SEQ ID NO: 127 - protein, 38 aa, Artificial Sequence
  Description of Artificial Sequence: Synthetic polypeptide
GSMCMPCFTTDHQMARACDDCCGGRGRGACYGPQCLCR

SEQ ID NO: 128 - protein, 38 aa, Artificial Sequence
  Description of Artificial Sequence: Synthetic polypeptide
GSMCMPCFTTDHQMARRCDDCCGGRGRGACYGPQCLCR

SEQ ID NO: 129 - protein, 38 aa, Artificial Sequence
  Description of Artificial Sequence: Synthetic polypeptide
GSMCMPCFTTDHQMARKCDDCCGGKGRGRCYGPQCLCR

SEQ ID NO: 130 - protein, 38 aa, Artificial Sequence
  Description of Artificial Sequence: Synthetic polypeptide
GSMCMPCFTTDHQMARACDDCCGGKGRGRCYGPQCLCR

SEQ ID NO: 131 - protein, 38 aa, Artificial Sequence
  Description of Artificial Sequence: Synthetic polypeptide
GSMCMPCFTTDHQMARKCDDCCGGAGRGRCYGPQCLCR

SEQ ID NO: 132 - protein, 38 aa, Artificial Sequence
  Description of Artificial Sequence: Synthetic polypeptide
GSMCMPCFTTDHQMARACDDCCGGAGRGRCYGPQCLCR

SEQ ID NO: 133 - protein, 38 aa, Artificial Sequence
  Description of Artificial Sequence: Synthetic polypeptide
GSMCMPCFTTDHQMARRCDDCCGGAGRGRCYGPQCLCR

SEQ ID NO: 134 - protein, 38 aa, Artificial Sequence
  Description of Artificial Sequence: Synthetic polypeptide
GSMCMPCFTTDHQMARACDDCCGGRGRGRCYGPQCLCR

SEQ ID NO: 135 - protein, 38 aa, Artificial Sequence
  Description of Artificial Sequence: Synthetic polypeptide
GSKCMPCFTTDHQMARRCDDCCGGRGRGRCYGPQCLCR

SEQ ID NO: 136 - protein, 38 aa, Artificial Sequence
  Description of Artificial Sequence: Synthetic polypeptide
GSACAPCFTTDHQAARRCDDCCGGRGRGRCYGPQCLCR

SEQ ID NO: 137 - protein, 38 aa, Artificial Sequence
  Description of Artificial Sequence: Synthetic polypeptide
GSKCAPCFTTDHQAARRCDDCCGGRGRGRCYGPQCLCR

SEQ ID NO: 138 - protein, 38 aa, Artificial Sequence
  Description of Artificial Sequence: Synthetic polypeptide
  MOD_RES (17)..(17): Citrulline
  MOD_RES (25)..(25): Citrulline
GSMCMPCFTTDHQMARXCDDCCGGXGRGKCYGPQCLCR

SEQ ID NO: 139 - protein, 38 aa, Artificial Sequence
  Description of Artificial Sequence: Synthetic polypeptide
  MOD_RES (17)..(17): Citrulline
  MOD_RES (25)..(25): Citrulline
  MOD_RES (29)..(29): Citrulline
GSMCMPCFTTDHQMARXCDDCCGGXGRGXCYGPQCLCR

SEQ ID NO: 140 - protein, 38 aa, Artificial Sequence
  Description of Artificial Sequence: Synthetic polypeptide
  MOD_RES (17)..(17): Citrulline
  MOD_RES (25)..(25): Citrulline
  MOD_RES (29)..(29): Citrulline
GSKCMPCFTTDHQMARXCDDCCGGXGRGXCYGPQCLCR

SEQ ID NO: 141 - protein, 38 aa, Artificial Sequence
  Description of Artificial Sequence: Synthetic polypeptide
  MOD_RES (17)..(17): Citrulline
  MOD_RES (25)..(25): Citrulline
GSACAPCFTTDHQAARXCDDCCGGXGRGKCYGPQCLCR

SEQ ID NO: 142 - protein, 38 aa, Artificial Sequence
  Description of Artificial Sequence: Synthetic polypeptide
  MOD_RES (17)..(17): Citrulline
  MOD_RES (25)..(25): Citrulline
  MOD_RES (29)..(29): Citrulline
GSACAPCFTTDHQAARXCDDCCGGXGRGXCYGPQCLCR

SEQ ID NO: 143 - protein, 38 aa, Artificial Sequence
  Description of Artificial Sequence: Synthetic polypeptide
  MOD_RES (17)..(17): Citrulline
  MOD_RES (25)..(25): Citrulline
  MOD_RES (29)..(29): Citrulline
GSKCAPCFTTDHQAARXCDDCCGGXGRGXCYGPQCLCR

SEQ ID NO: 144 - protein, 45 aa, Artificial Sequence
  Description of Artificial Sequence: Synthetic polypeptide
GSMCMPCFTTDHQMARKCDDCCGGKGRGKCYGPQCLCRGAGAAGG

SEQ ID NO: 145 - protein, 45 aa, Artificial Sequence
  Description of Artificial Sequence: Synthetic polypeptide
GSMCMPCFTTDHQMARACDDCCGGKGRGKCYGPQCLCRGAGAAGG

SEQ ID NO: 146 - protein, 45 aa, Artificial Sequence
  Description of Artificial Sequence: Synthetic polypeptide
GSMCMPCFTTDHQMARRCDDCCGGKGRGKCYGPQCLCRGAGAAGG

SEQ ID NO: 147 - protein, 45 aa, Artificial Sequence
  Description of Artificial Sequence: Synthetic polypeptide
GSMCMPCFTTDHQMARKCDDCCGGAGRGKCYGPQCLCRGAGAAGG

SEQ ID NO: 148 - protein, 45 aa, Artificial Sequence
  Description of Artificial Sequence: Synthetic polypeptide
GSMCMPCFTTDHQMARACDDCCGGAGRGKCYGPQCLCRGAGAAGG

SEQ ID NO: 149 - protein, 45 aa, Artificial Sequence
  Description of Artificial Sequence: Synthetic polypeptide
GSMCMPCFTTDHQMARRCDDCCGGAGRGKCYGPQCLCRGAGAAGG

SEQ ID NO: 150 - protein, 45 aa, Artificial Sequence
  Description of Artificial Sequence: Synthetic polypeptide
GSMCMPCFTTDHQMARKCDDCCGGRGRGKCYGPQCLCRGAGAAGG

SEQ ID NO: 151 - protein, 45 aa, Artificial Sequence
  Description of Artificial Sequence: Synthetic polypeptide
GSMCMPCFTTDHQMARACDDCCGGRGRGKCYGPQCLCRGAGAAGG

SEQ ID NO: 152 - protein, 45 aa, Artificial Sequence
  Description of Artificial Sequence: Synthetic polypeptide
GSMCMPCFTTDHQMARRCDDCCGGRGRGKCYGPQCLCRGAGAAGG

SEQ ID NO: 153 - protein, 45 aa, Artificial Sequence
  Description of Artificial Sequence: Synthetic polypeptide
GSMCMPCFTTDHQMARKCDDCCGGKGRGACYGPQCLCRGAGAAGG

SEQ ID NO: 154 - protein, 45 aa, Artificial Sequence
  Description of Artificial Sequence: Synthetic polypeptide
GSMCMPCFTTDHQMARACDDCCGGKGRGACYGPQCLCRGAGAAGG

SEQ ID NO: 155 - protein, 45 aa, Artificial Sequence
  Description of Artificial Sequence: Synthetic polypeptide
GSMCMPCFTTDHQMARRCDDCCGGKGRGACYGPQCLCRGAGAAGG

SEQ ID NO: 156 - protein, 45 aa, Artificial Sequence
  Description of Artificial Sequence: Synthetic polypeptide
GSMCMPCFTTDHQMARKCDDCCGGAGRGACYGPQCLCRGAGAAGG

SEQ ID NO: 157 - protein, 45 aa, Artificial Sequence
  Description of Artificial Sequence: Synthetic polypeptide
GSMCMPCFTTDHQMARACDDCCGGAGRGACYGPQCLCRGAGAAGG

SEQ ID NO: 158 - protein, 45 aa, Artificial Sequence
  Description of Artificial Sequence: Synthetic polypeptide
GSMCMPCFTTDHQMARRCDDCCGGAGRGACYGPQCLCRGAGAAGG

SEQ ID NO: 159 - protein, 45 aa, Artificial Sequence
  Description of Artificial Sequence: Synthetic polypeptide
GSMCMPCFTTDHQMARKCDDCCGGRGRGACYGPQCLCRGAGAAGG

SEQ ID NO: 160 - protein, 45 aa, Artificial Sequence
  Description of Artificial Sequence: Synthetic polypeptide
GSMCMPCFTTDHQMARACDDCCGGRGRGACYGPQCLCRGAGAAGG

SEQ ID NO: 161 - protein, 45 aa, Artificial Sequence
  Description of Artificial Sequence: Synthetic polypeptide
GSMCMPCFTTDHQMARRCDDCCGGRGRGACYGPQCLCRGAGAAGG

SEQ ID NO: 162 - protein, 45 aa, Artificial Sequence
  Description of Artificial Sequence: Synthetic polypeptide
GSMCMPCFTTDHQMARKCDDCCGGKGRGRCYGPQCLCRGAGAAGG

SEQ ID NO: 163 - protein, 45 aa, Artificial Sequence
  Description of Artificial Sequence: Synthetic polypeptide
GSMCMPCFTTDHQMARACDDCCGGKGRGRCYGPQCLCRGAGAAGG

SEQ ID NO: 164 - protein, 45 aa, Artificial Sequence
  Description of Artificial Sequence: Synthetic polypeptide
GSMCMPCFTTDHQMARRCDDCCGGKGRGRCYGPQCLCRGAGAAGG

SEQ ID NO: 165 - protein, 45 aa, Artificial Sequence
  Description of Artificial Sequence: Synthetic polypeptide
GSMCMPCFTTDHQMARKCDDCCGGAGRGRCYGPQCLCRGAGAAGG

SEQ ID NO: 166 - protein, 45 aa, Artificial Sequence
  Description of Artificial Sequence: Synthetic polypeptide
GSMCMPCFTTDHQMARACDDCCGGAGRGRCYGPQCLCRGAGAAGG

SEQ ID NO: 167 - protein, 45 aa, Artificial Sequence
  Description of Artificial Sequence: Synthetic polypeptide
GSMCMPCFTTDHQMARRCDDCCGGAGRGRCYGPQCLCRGAGAAGG

SEQ ID NO: 168 - protein, 45 aa, Artificial Sequence
  Description of Artificial Sequence: Synthetic polypeptide
GSMCMPCFTTDHQMARKCDDCCGGRGRGRCYGPQCLCRGAGAAGG

SEQ ID NO: 169 - protein, 45 aa, Artificial Sequence
  Description of Artificial Sequence: Synthetic polypeptide
GSMCMPCFTTDHQMARACDDCCGGRGRGRCYGPQCLCRGAGAAGG

SEQ ID NO: 170 - protein, 45 aa, Artificial Sequence
  Description of Artificial Sequence: Synthetic polypeptide
GSMCMPCFTTDHQMARRCDDCCGGRGRGRCYGPQCLCRGAGAAGG

SEQ ID NO: 171 - protein, 45 aa, Artificial Sequence
  Description of Artificial Sequence: Synthetic polypeptide
GSKCMPCFTTDHQMARRCDDCCGGRGRGRCYGPQCLCRGAGAAGG

SEQ ID NO: 172 - protein, 45 aa, Artificial Sequence
  Description of Artificial Sequence: Synthetic polypeptide
GSACAPCFTTDHQAARRCDDCCGGRGRGRCYGPQCLCRGAGAAGG

SEQ ID NO: 173 - protein, 45 aa, Artificial Sequence
  Description of Artificial Sequence: Synthetic polypeptide
GSKCAPCFTTDHQAARRCDDCCGGRGRGRCYGPQCLCRGAGAAGG

SEQ ID NO: 174 - protein, 45 aa, Artificial Sequence
  Description of Artificial Sequence: Synthetic polypeptide
  MOD_RES (17)..(17): Citrulline
  MOD_RES (25)..(25): Citrulline
GSMCMPCFTTDHQMARXCDDCCGGXGRGKCYGPQCLCRGAGAAGG

SEQ ID NO: 175 - protein, 45 aa, Artificial Sequence
  Description of Artificial Sequence: Synthetic polypeptide
  MOD_RES (17)..(17): Citrulline
  MOD_RES (25)..(25): Citrulline
  MOD_RES (29)..(29): Citrulline
GSMCMPCFTTDHQMARXCDDCCGGXGRGXCYGPQCLCRGAGAAGG

SEQ ID NO: 176 - protein, 45 aa, Artificial Sequence
  Description of Artificial Sequence: Synthetic polypeptide
  MOD_RES (17)..(17): Citrulline
  MOD_RES (25)..(25): Citrulline
  MOD_RES (29)..(29): Citrulline
GSKCMPCFTTDHQMARXCDDCCGGXGRGXCYGPQCLCRGAGAAGG

SEQ ID NO: 177 - protein, 45 aa, Artificial Sequence
  Description of Artificial Sequence: Synthetic polypeptide
  MOD_RES (17)..(17): Citrulline
  MOD_RES (25)..(25): Citrulline
GSACAPCFTTDHQAARXCDDCCGGXGRGKCYGPQCLCRGAGAAGG

SEQ ID NO: 178 - protein, 45 aa, Artificial Sequence
  Description of Artificial Sequence: Synthetic polypeptide
  MOD_RES (17)..(17): Citrulline
  MOD_RES (25)..(25): Citrulline
  MOD_RES (29)..(29): Citrulline
GSACAPCFTTDHQAARXCDDCCGGXGRGXCYGPQCLCRGAGAAGG

SEQ ID NO: 179 - protein, 45 aa, Artificial Sequence
  Description of Artificial Sequence: Synthetic polypeptide
  MOD_RES (17)..(17): Citrulline
  MOD_RES (25)..(25): Citrulline
  MOD_RES (29)..(29): Citrulline
GSKCAPCFTTDHQAARXCDDCCGGXGRGXCYGPQCLCRGAGAAGG

SEQ ID NO: 180 - protein, 38 aa, Artificial Sequence
  Description of Artificial Sequence: Synthetic polypeptide
GSMCMPCFTTDHQMVRKCDDCCGGKGRGKCYGPQCLCR

SEQ ID NO: 181 - protein, 38 aa, Artificial Sequence
  Description of Artificial Sequence: Synthetic polypeptide
GSMCMPCFTTDHQMVRVCDDCCGGKGRGKCYGPQCLCR

SEQ ID NO: 182 - protein, 38 aa, Artificial Sequence
  Description of Artificial Sequence: Synthetic polypeptide
GSMCMPCFTTDHQMVRRCDDCCGGKGRGKCYGPQCLCR

SEQ ID NO: 183 - protein, 38 aa, Artificial Sequence
  Description of Artificial Sequence: Synthetic polypeptide
GSMCMPCFTTDHQMVRKCDDCCGGVGRGKCYGPQCLCR

SEQ ID NO: 184 - protein, 38 aa, Artificial Sequence
  Description of Artificial Sequence: Synthetic polypeptide
GSMCMPCFTTDHQMVRVCDDCCGGVGRGKCYGPQCLCR

SEQ ID NO: 185 - protein, 38 aa, Artificial Sequence
  Description of Artificial Sequence: Synthetic polypeptide
GSMCMPCFTTDHQMVRRCDDCCGGVGRGKCYGPQCLCR

SEQ ID NO: 186 - protein, 38 aa, Artificial Sequence
  Description of Artificial Sequence: Synthetic polypeptide
GSMCMPCFTTDHQMVRKCDDCCGGRGRGKCYGPQCLCR

SEQ ID NO: 187 - protein, 38 aa, Artificial Sequence
  Description of Artificial Sequence: Synthetic polypeptide
GSMCMPCFTTDHQMVRVCDDCCGGRGRGKCYGPQCLCR

SEQ ID NO: 188 - protein, 38 aa, Artificial Sequence
  Description of Artificial Sequence: Synthetic polypeptide
GSMCMPCFTTDHQMVRRCDDCCGGRGRGKCYGPQCLCR

SEQ ID NO: 189 - protein, 38 aa, Artificial Sequence
  Description of Artificial Sequence: Synthetic polypeptide
GSMCMPCFTTDHQMVRKCDDCCGGKGRGVCYGPQCLCR

SEQ ID NO: 190 - protein, 38 aa, Artificial Sequence
  Description of Artificial Sequence: Synthetic polypeptide
GSMCMPCFTTDHQMVRVCDDCCGGKGRGVCYGPQCLCR

SEQ ID NO: 191 - protein, 38 aa, Artificial Sequence
  Description of Artificial Sequence: Synthetic polypeptide
GSMCMPCFTTDHQMVRRCDDCCGGKGRGVCYGPQCLCR

SEQ ID NO: 192 - protein, 38 aa, Artificial Sequence
  Description of Artificial Sequence: Synthetic polypeptide
GSMCMPCFTTDHQMVRKCDDCCGGVGRGVCYGPQCLCR

SEQ ID NO: 193 - protein, 38 aa, Artificial Sequence
  Description of Artificial Sequence: Synthetic polypeptide
GSMCMPCFTTDHQMVRVCDDCCGGVGRGVCYGPQCLCR

SEQ ID NO: 194 - protein, 38 aa, Artificial Sequence
  Description of Artificial Sequence: Synthetic polypeptide
GSMCMPCFTTDHQMVRRCDDCCGGVGRGVCYGPQCLCR

SEQ ID NO: 195 - protein, 38 aa, Artificial Sequence
  Description of Artificial Sequence: Synthetic polypeptide
GSMCMPCFTTDHQMVRKCDDCCGGRGRGVCYGPQCLCR

SEQ ID NO: 196 - protein, 38 aa, Artificial Sequence
  Description of Artificial Sequence: Synthetic polypeptide
GSMCMPCFTTDHQMVRVCDDCCGGRGRGVCYGPQCLCR

SEQ ID NO: 197 - protein, 38 aa, Artificial Sequence
  Description of Artificial Sequence: Synthetic polypeptide
GSMCMPCFTTDHQMVRRCDDCCGGRGRGVCYGPQCLCR

SEQ ID NO: 198 - protein, 38 aa, Artificial Sequence
  Description of Artificial Sequence: Synthetic polypeptide
GSMCMPCFTTDHQMVRKCDDCCGGKGRGRCYGPQCLCR

SEQ ID NO: 199 - protein, 38 aa, Artificial Sequence
  Description of Artificial Sequence: Synthetic polypeptide
GSMCMPCFTTDHQMVRVCDDCCGGKGRGRCYGPQCLCR

SEQ ID NO: 200 - protein, 38 aa, Artificial Sequence
  Description of Artificial Sequence: Synthetic polypeptide
GSMCMPCFTTDHQMVRRCDDCCGGKGRGRCYGPQCLCR

SEQ ID NO: 201 - protein, 38 aa, Artificial Sequence
  Description of Artificial Sequence: Synthetic polypeptide
GSMCMPCFTTDHQMVRKCDDCCGGVGRGRCYGPQCLCR

SEQ ID NO: 202 - protein, 38 aa, Artificial Sequence
  Description of Artificial Sequence: Synthetic polypeptide
GSMCMPCFTTDHQMVRVCDDCCGGVGRGRCYGPQCLCR

SEQ ID NO: 203 - protein, 38 aa, Artificial Sequence
  Description of Artificial Sequence: Synthetic polypeptide
GSMCMPCFTTDHQMVRRCDDCCGGVGRGRCYGPQCLCR

SEQ ID NO: 204 - protein, 38 aa, Artificial Sequence
  Description of Artificial Sequence: Synthetic polypeptide
GSMCMPCFTTDHQMVRKCDDCCGGRGRGRCYGPQCLCR

SEQ ID NO: 205 - protein, 38 aa, Artificial Sequence
  Description of Artificial Sequence: Synthetic polypeptide
GSMCMPCFTTDHQMVRVCDDCCGGRGRGRCYGPQCLCR

SEQ ID NO: 206 - protein, 38 aa, Artificial Sequence
  Description of Artificial Sequence: Synthetic polypeptide
GSMCMPCFTTDHQMVRRCDDCCGGRGRGRCYGPQCLCR

SEQ ID NO: 207 - protein, 38 aa, Artificial Sequence
  Description of Artificial Sequence: Synthetic polypeptide
GSKCMPCFTTDHQMVRRCDDCCGGRGRGRCYGPQCLCR

SEQ ID NO: 208 - protein, 38 aa, Artificial Sequence
  Description of Artificial Sequence: Synthetic polypeptide
GSVCVPCFTTDHQVVRRCDDCCGGRGRGRCYGPQCLCR

SEQ ID NO: 209 - protein, 38 aa, Artificial Sequence
  Description of Artificial Sequence: Synthetic polypeptide
GSKCVPCFTTDHQVVRRCDDCCGGRGRGRCYGPQCLCR

SEQ ID NO: 210 - protein, 38 aa, Artificial Sequence
  Description of Artificial Sequence: Synthetic polypeptide
  MOD_RES (17)..(17): Citrulline
  MOD_RES (25)..(25): Citrulline
GSMCMPCFTTDHQMVRXCDDCCGGXGRGKCYGPQCLCR

SEQ ID NO: 211 - protein, 38 aa, Artificial Sequence
  Description of Artificial Sequence: Synthetic polypeptide
  MOD_RES (17)..(17): Citrulline
  MOD_RES (25)..(25): Citrulline
  MOD_RES (29)..(29): Citrulline
GSMCMPCFTTDHQMVRXCDDCCGGXGRGXCYGPQCLCR

SEQ ID NO: 212 - protein, 38 aa, Artificial Sequence
  Description of Artificial Sequence: Synthetic polypeptide
  MOD_RES (17)..(17): Citrulline
  MOD_RES (25)..(25): Citrulline
  MOD_RES (29)..(29): Citrulline
GSKCMPCFTTDHQMVRXCDDCCGGXGRGXCYGPQCLCR

SEQ ID NO: 213 - protein, 38 aa, Artificial Sequence
  Description of Artificial Sequence: Synthetic polypeptide
  MOD_RES (17)..(17): Citrulline
  MOD_RES (25)..(25): Citrulline
GSVCVPCFTTDHQVVRXCDDCCGGXGRGKCYGPQCLCR

SEQ ID NO: 214 - protein, 38 aa, Artificial Sequence
  Description of Artificial Sequence: Synthetic polypeptide
  MOD_RES (17)..(17): Citrulline
  MOD_RES (25)..(25): Citrulline
  MOD_RES (29)..(29): Citrulline
GSVCVPCFTTDHQVVRXCDDCCGGXGRGXCYGPQCLCR

SEQ ID NO: 215 - protein, 38 aa, Artificial Sequence
  Description of Artificial Sequence: Synthetic polypeptide
  MOD_RES (17)..(17): Citrulline
  MOD_RES (25)..(25): Citrulline
  MOD_RES (29)..(29): Citrulline
GSKCVPCFTTDHQVVRXCDDCCGGXGRGXCYGPQCLCR

SEQ ID NO: 216 - protein, 45 aa, Artificial Sequence
  Description of Artificial Sequence: Synthetic polypeptide
GSMCMPCFTTDHQMVRKCDDCCGGKGRGKCYGPQCLCRGAGAAGG

SEQ ID NO: 217 - protein, 45 aa, Artificial Sequence
  Description of Artificial Sequence: Synthetic polypeptide
GSMCMPCFTTDHQMVRVCDDCCGGKGRGKCYGPQCLCRGAGAAGG

SEQ ID NO: 218 - protein, 45 aa, Artificial Sequence
  Description of Artificial Sequence: Synthetic polypeptide
GSMCMPCFTTDHQMVRRCDDCCGGKGRGKCYGPQCLCRGAGAAGG

SEQ ID NO: 219 - protein, 45 aa, Artificial Sequence
  Description of Artificial Sequence: Synthetic polypeptide
GSMCMPCFTTDHQMVRKCDDCCGGVGRGKCYGPQCLCRGAGAAGG

SEQ ID NO: 220 - protein, 45 aa, Artificial Sequence
  Description of Artificial Sequence: Synthetic polypeptide
GSMCMPCFTTDHQMVRVCDDCCGGVGRGKCYGPQCLCRGAGAAGG

SEQ ID NO: 221 - protein, 45 aa, Artificial Sequence
  Description of Artificial Sequence: Synthetic polypeptide
GSMCMPCFTTDHQMVRRCDDCCGGVGRGKCYGPQCLCRGAGAAGG

SEQ ID NO: 222 - protein, 45 aa, Artificial Sequence
  Description of Artificial Sequence: Synthetic polypeptide
GSMCMPCFTTDHQMVRKCDDCCGGRGRGKCYGPQCLCRGAGAAGG

SEQ ID NO: 223 - protein, 45 aa, Artificial Sequence
  Description of Artificial Sequence: Synthetic polypeptide
GSMCMPCFTTDHQMVRVCDDCCGGRGRGKCYGPQCLCRGAGAAGG

SEQ ID NO: 224 - protein, 45 aa, Artificial Sequence
  Description of Artificial Sequence: Synthetic polypeptide
GSMCMPCFTTDHQMVRRCDDCCGGRGRGKCYGPQCLCRGAGAAGG

SEQ ID NO: 225 - protein, 45 aa, Artificial Sequence
  Description of Artificial Sequence: Synthetic polypeptide
GSMCMPCFTTDHQMVRKCDDCCGGKGRGVCYGPQCLCRGAGAAGG

SEQ ID NO: 226 - protein, 45 aa, Artificial Sequence
  Description of Artificial Sequence: Synthetic polypeptide
GSMCMPCFTTDHQMVRVCDDCCGGKGRGVCYGPQCLCRGAGAAGG

SEQ ID NO: 227 - protein, 45 aa, Artificial Sequence
  Description of Artificial Sequence: Synthetic polypeptide
GSMCMPCFTTDHQMVRRCDDCCGGKGRGVCYGPQCLCRGAGAAGG

SEQ ID NO: 228 - protein, 45 aa, Artificial Sequence
  Description of Artificial Sequence: Synthetic polypeptide
GSMCMPCFTTDHQMVRKCDDCCGGVGRGVCYGPQCLCRGAGAAGG

SEQ ID NO: 229 - protein, 45 aa, Artificial Sequence
  Description of Artificial Sequence: Synthetic polypeptide
GSMCMPCFTTDHQMVRVCDDCCGGVGRGVCYGPQCLCRGAGAAGG

SEQ ID NO: 230 - protein, 45 aa, Artificial Sequence
  Description of Artificial Sequence: Synthetic polypeptide
GSMCMPCFTTDHQMVRRCDDCCGGVGRGVCYGPQCLCRGAGAAGG

SEQ ID NO: 231 - protein, 45 aa, Artificial Sequence
  Description of Artificial Sequence: Synthetic polypeptide
GSMCMPCFTTDHQMVRKCDDCCGGRGRGVCYGPQCLCRGAGAAGG

SEQ ID NO: 232 - protein, 45 aa, Artificial Sequence
  Description of Artificial Sequence: Synthetic polypeptide
GSMCMPCFTTDHQMVRVCDDCCGGRGRGVCYGPQCLCRGAGAAGG

SEQ ID NO: 233 - protein, 45 aa, Artificial Sequence
  Description of Artificial Sequence: Synthetic polypeptide
GSMCMPCFTTDHQMVRRCDDCCGGRGRGVCYGPQCLCRGAGAAGG

SEQ ID NO: 234 - protein, 45 aa, Artificial Sequence
  Description of Artificial Sequence: Synthetic polypeptide
GSMCMPCFTTDHQMVRKCDDCCGGKGRGRCYGPQCLCRGAGAAGG

SEQ ID NO: 235 - protein, 45 aa, Artificial Sequence
  Description of Artificial Sequence: Synthetic polypeptide
GSMCMPCFTTDHQMVRVCDDCCGGKGRGRCYGPQCLCRGAGAAGG

SEQ ID NO: 236 - protein, 45 aa, Artificial Sequence
  Description of Artificial Sequence: Synthetic polypeptide
GSMCMPCFTTDHQMVRRCDDCCGGKGRGRCYGPQCLCRGAGAAGG

SEQ ID NO: 237 - protein, 45 aa, Artificial Sequence
  Description of Artificial Sequence: Synthetic polypeptide
GSMCMPCFTTDHQMVRKCDDCCGGVGRGRCYGPQCLCRGAGAAGG

SEQ ID NO: 238 - protein, 45 aa, Artificial Sequence
  Description of Artificial Sequence: Synthetic polypeptide
GSMCMPCFTTDHQMVRVCDDCCGGVGRGRCYGPQCLCRGAGAAGG

SEQ ID NO: 239 - protein, 45 aa, Artificial Sequence
  Description of Artificial Sequence: Synthetic polypeptide
GSMCMPCFTTDHQMVRRCDDCCGGVGRGRCYGPQCLCRGAGAAGG

SEQ ID NO: 240 - protein, 45 aa, Artificial Sequence
  Description of Artificial Sequence: Synthetic polypeptide
GSMCMPCFTTDHQMVRKCDDCCGGRGRGRCYGPQCLCRGAGAAGG

SEQ ID NO: 241 - protein, 45 aa, Artificial Sequence
  Description of Artificial Sequence: Synthetic polypeptide
GSMCMPCFTTDHQMVRVCDDCCGGRGRGRCYGPQCLCRGAGAAGG

SEQ ID NO: 242 - protein, 45 aa, Artificial Sequence
  Description of Artificial Sequence: Synthetic polypeptide
GSMCMPCFTTDHQMVRRCDDCCGGRGRGRCYGPQCLCRGAGAAGG

SEQ ID NO: 243 - protein, 45 aa, Artificial Sequence
  Description of Artificial Sequence: Synthetic polypeptide
GSKCMPCFTTDHQMVRRCDDCCGGRGRGRCYGPQCLCRGAGAAGG

SEQ ID NO: 244 - protein, 45 aa, Artificial Sequence
  Description of Artificial Sequence: Synthetic polypeptide
GSVCVPCFTTDHQVVRRCDDCCGGRGRGRCYGPQCLCRGAGAAGG

SEQ ID NO: 245 - protein, 45 aa, Artificial Sequence
  Description of Artificial Sequence: Synthetic polypeptide
GSKCVPCFTTDHQVVRRCDDCCGGRGRGRCYGPQCLCRGAGAAGG

SEQ ID NO: 246 - protein, 45 aa, Artificial Sequence
  Description of Artificial Sequence: Synthetic polypeptide
  MOD_RES (17)..(17): Citrulline
  MOD_RES (25)..(25): Citrulline
GSMCMPCFTTDHQMVRXCDDCCGGXGRGKCYGPQCLCRGAGAAGG

SEQ ID NO: 247 - protein, 45 aa, Artificial Sequence
  Description of Artificial Sequence: Synthetic polypeptide
  MOD_RES (17)..(17): Citrulline
  MOD_RES (25)..(25): Citrulline
  MOD_RES (29)..(29): Citrulline
GSMCMPCFTTDHQMVRXCDDCCGGXGRGXCYGPQCLCRGAGAAGG

SEQ ID NO: 248 - protein, 45 aa, Artificial Sequence
  Description of Artificial Sequence: Synthetic polypeptide
  MOD_RES (17)..(17): Citrulline
  MOD_RES (25)..(25): Citrulline
  MOD_RES (29)..(29): Citrulline
GSKCMPCFTTDHQMVRXCDDCCGGXGRGXCYGPQCLCRGAGAAGG

SEQ ID NO: 249 - protein, 45 aa, Artificial Sequence
  Description of Artificial Sequence: Synthetic polypeptide
  MOD_RES (17)..(17): Citrulline
  MOD_RES (25)..(25): Citrulline
GSVCVPCFTTDHQVVRXCDDCCGGXGRGKCYGPQCLCRGAGAAGG

SEQ ID NO: 250 - protein, 45 aa, Artificial Sequence
  Description of Artificial Sequence: Synthetic polypeptide
  MOD_RES (17)..(17): Citrulline
  MOD_RES (25)..(25): Citrulline
  MOD_RES (29)..(29): Citrulline
GSVCVPCFTTDHQVVRXCDDCCGGXGRGXCYGPQCLCRGAGAAGG

SEQ ID NO: 251 - protein, 45 aa, Artificial Sequence
  Description of Artificial Sequence: Synthetic polypeptide
  MOD_RES (17)..(17): Citrulline
  MOD_RES (25)..(25): Citrulline
  MOD_RES (29)..(29): Citrulline
GSKCVPCFTTDHQVVRXCDDCCGGXGRGXCYGPQCLCRGAGAAGG

SEQ ID NO: 252 - protein, 38 aa, Artificial Sequence
  Description of Artificial Sequence: Synthetic polypeptide
GSMCMPCFTTDHQMLRKCDDCCGGKGRGKCYGPQCLCR

SEQ ID NO: 253 - protein, 38 aa, Artificial Sequence
  Description of Artificial Sequence: Synthetic polypeptide
GSMCMPCFTTDHQMLRLCDDCCGGKGRGKCYGPQCLCR

SEQ ID NO: 254 - protein, 38 aa, Artificial Sequence
  Description of Artificial Sequence: Synthetic polypeptide
GSMCMPCFTTDHQMLRRCDDCCGGKGRGKCYGPQCLCR

SEQ ID NO: 255 - protein, 38 aa, Artificial Sequence
  Description of Artificial Sequence: Synthetic polypeptide
GSMCMPCFTTDHQMLRKCDDCCGGLGRGKCYGPQCLCR

SEQ ID NO: 256 - protein, 38 aa, Artificial Sequence
  Description of Artificial Sequence: Synthetic polypeptide
GSMCMPCFTTDHQMLRLCDDCCGGLGRGKCYGPQCLCR

SEQ ID NO: 257 - protein, 38 aa, Artificial Sequence
  Description of Artificial Sequence: Synthetic polypeptide
GSMCMPCFTTDHQMLRRCDDCCGGLGRGKCYGPQCLCR

SEQ ID NO: 258 - protein, 38 aa, Artificial Sequence
  Description of Artificial Sequence: Synthetic polypeptide
GSMCMPCFTTDHQMLRKCDDCCGGRGRGKCYGPQCLCR

SEQ ID NO: 259 - protein, 38 aa, Artificial Sequence
  Description of Artificial Sequence: Synthetic polypeptide
GSMCMPCFTTDHQMLRLCDDCCGGRGRGKCYGPQCLCR

SEQ ID NO: 260 - protein, 38 aa, Artificial Sequence
  Description of Artificial Sequence: Synthetic polypeptide
GSMCMPCFTTDHQMLRRCDDCCGGRGRGKCYGPQCLCR

SEQ ID NO: 261 - protein, 38 aa, Artificial Sequence
  Description of Artificial Sequence: Synthetic polypeptide
GSMCMPCFTTDHQMLRKCDDCCGGKGRGLCYGPQCLCR

SEQ ID NO: 262 - protein, 38 aa, Artificial Sequence
  Description of Artificial Sequence: Synthetic polypeptide
GSMCMPCFTTDHQMLRLCDDCCGGKGRGLCYGPQCLCR

SEQ ID NO: 263 - protein, 38 aa, Artificial Sequence
  Description of Artificial Sequence: Synthetic polypeptide
GSMCMPCFTTDHQMLRRCDDCCGGKGRGLCYGPQCLCR

SEQ ID NO: 264 - protein, 38 aa, Artificial Sequence
  Description of Artificial Sequence: Synthetic polypeptide
GSMCMPCFTTDHQMLRKCDDCCGGLGRGLCYGPQCLCR

SEQ ID NO: 265 - protein, 38 aa, Artificial Sequence
  Description of Artificial Sequence: Synthetic polypeptide
GSMCMPCFTTDHQMLRLCDDCCGGLGRGLCYGPQCLCR

SEQ ID NO: 266 - protein, 38 aa, Artificial Sequence
  Description of Artificial Sequence: Synthetic polypeptide
GSMCMPCFTTDHQMLRRCDDCCGGLGRGLCYGPQCLCR

SEQ ID NO: 267 - protein, 38 aa, Artificial Sequence
  Description of Artificial Sequence: Synthetic polypeptide
GSMCMPCFTTDHQMLRKCDDCCGGRGRGLCYGPQCLCR

SEQ ID NO: 268 - protein, 38 aa, Artificial Sequence
  Description of Artificial Sequence: Synthetic polypeptide
GSMCMPCFTTDHQMLRLCDDCCGGRGRGLCYGPQCLCR

SEQ ID NO: 269 - protein, 38 aa, Artificial Sequence
  Description of Artificial Sequence: Synthetic polypeptide
GSMCMPCFTTDHQMLRRCDDCCGGRGRGLCYGPQCLCR

SEQ ID NO: 270 - protein, 38 aa, Artificial Sequence
  Description of Artificial Sequence: Synthetic polypeptide
GSMCMPCFTTDHQMLRKCDDCCGGKGRGRCYGPQCLCR

SEQ ID NO: 271 - protein, 38 aa, Artificial Sequence
  Description of Artificial Sequence: Synthetic polypeptide
GSMCMPCFTTDHQMLRLCDDCCGGKGRGRCYGPQCLCR

SEQ ID NO: 272 - protein, 38 aa, Artificial Sequence
  Description of Artificial Sequence: Synthetic polypeptide
GSMCMPCFTTDHQMLRRCDDCCGGKGRGRCYGPQCLCR

SEQ ID NO: 273 - protein, 38 aa, Artificial Sequence
  Description of Artificial Sequence: Synthetic polypeptide
GSMCMPCFTTDHQMLRKCDDCCGGLGRGRCYGPQCLCR

SEQ ID NO: 274 - protein, 38 aa, Artificial Sequence
  Description of Artificial Sequence: Synthetic polypeptide
GSMCMPCFTTDHQMLRLCDDCCGGLGRGRCYGPQCLCR

SEQ ID NO: 275 - protein, 38 aa, Artificial Sequence
  Description of Artificial Sequence: Synthetic polypeptide
GSMCMPCFTTDHQMLRRCDDCCGGLGRGRCYGPQCLCR

SEQ ID NO: 276 - protein, 38 aa, Artificial Sequence
  Description of Artificial Sequence: Synthetic polypeptide
GSMCMPCFTTDHQMLRKCDDCCGGRGRGRCYGPQCLCR

SEQ ID NO: 277 - protein, 38 aa, Artificial Sequence
  Description of Artificial Sequence: Synthetic polypeptide
GSMCMPCFTTDHQMLRLCDDCCGGRGRGRCYGPQCLCR

SEQ ID NO: 278 - protein, 38 aa, Artificial Sequence
  Description of Artificial Sequence: Synthetic polypeptide
GSMCMPCFTTDHQMLRRCDDCCGGRGRGRCYGPQCLCR

SEQ ID NO: 279 - protein, 38 aa, Artificial Sequence
  Description of Artificial Sequence: Synthetic polypeptide
GSKCMPCFTTDHQMLRRCDDCCGGRGRGRCYGPQCLCR

SEQ ID NO: 280 - protein, 38 aa, Artificial Sequence
  Description of Artificial Sequence: Synthetic polypeptide
GSLCLPCFTTDHQLLRRCDDCCGGRGRGRCYGPQCLCR

SEQ ID NO: 281 - protein, 38 aa, Artificial Sequence
  Description of Artificial Sequence: Synthetic polypeptide
GSKCLPCFTTDHQLLRRCDDCCGGRGRGRCYGPQCLCR

SEQ ID NO: 282 - protein, 38 aa, Artificial Sequence
  Description of Artificial Sequence: Synthetic polypeptide
  MOD_RES (17)..(17): Citrulline
  MOD_RES (25)..(25): Citrulline
GSMCMPCFTTDHQMLRXCDDCCGGXGRGKCYGPQCLCR

SEQ ID NO: 283 - protein, 38 aa, Artificial Sequence
  Description of Artificial Sequence: Synthetic polypeptide
  MOD_RES (17)..(17): Citrulline
  MOD_RES (25)..(25): Citrulline
  MOD_RES (29)..(29): Citrulline
GSMCMPCFTTDHQMLRXCDDCCGGXGRGXCYGPQCLCR

SEQ ID NO: 284 - protein, 38 aa, Artificial Sequence
  Description of Artificial Sequence: Synthetic polypeptide
  MOD_RES (17)..(17): Citrulline
  MOD_RES (25)..(25): Citrulline
  MOD_RES (29)..(29): Citrulline
GSKCMPCFTTDHQMLRXCDDCCGGXGRGXCYGPQCLCR

SEQ ID NO: 285 - protein, 38 aa, Artificial Sequence
  Description of Artificial Sequence: Synthetic polypeptide
  MOD_RES (17)..(17): Citrulline
  MOD_RES (25)..(25): Citrulline
GSLCLPCFTTDHQLLRXCDDCCGGXGRGKCYGPQCLCR

SEQ ID NO: 286 - protein, 38 aa, Artificial Sequence
  Description of Artificial Sequence: Synthetic polypeptide
  MOD_RES (17)..(17): Citrulline
  MOD_RES (25)..(25): Citrulline
  MOD_RES (29)..(29): Citrulline
GSLCLPCFTTDHQLLRXCDDCCGGXGRGXCYGPQCLCR

SEQ ID NO: 287 - protein, 38 aa, Artificial Sequence
  Description of Artificial Sequence: Synthetic polypeptide
  MOD_RES (17)..(17): Citrulline
  MOD_RES (25)..(25): Citrulline
  MOD_RES (29)..(29): Citrulline
GSKCLPCFTTDHQLLRXCDDCCGGXGRGXCYGPQCLCR

SEQ ID NO: 288 - protein, 45 aa, Artificial Sequence
  Description of Artificial Sequence: Synthetic polypeptide
GSMCMPCFTTDHQMLRKCDDCCGGKGRGKCYGPQCLCRGAGAAGG

SEQ ID NO: 289 - protein, 45 aa, Artificial Sequence
  Description of Artificial Sequence: Synthetic polypeptide
GSMCMPCFTTDHQMLRLCDDCCGGKGRGKCYGPQCLCRGAGAAGG

SEQ ID NO: 290 - protein, 45 aa, Artificial Sequence
  Description of Artificial Sequence: Synthetic polypeptide
GSMCMPCFTTDHQMLRRCDDCCGGKGRGKCYGPQCLCRGAGAAGG

SEQ ID NO: 291 - protein, 45 aa, Artificial Sequence
  Description of Artificial Sequence: Synthetic polypeptide
GSMCMPCFTTDHQMLRKCDDCCGGLGRGKCYGPQCLCRGAGAAGG

SEQ ID NO: 292 - protein, 45 aa, Artificial Sequence
  Description of Artificial Sequence: Synthetic polypeptide
GSMCMPCFTTDHQMLRLCDDCCGGLGRGKCYGPQCLCRGAGAAGG

SEQ ID NO: 293 - protein, 45 aa, Artificial Sequence
  Description of Artificial Sequence: Synthetic polypeptide
GSMCMPCFTTDHQMLRRCDDCCGGLGRGKCYGPQCLCRGAGAAGG

SEQ ID NO: 294 - protein, 45 aa, Artificial Sequence
  Description of Artificial Sequence: Synthetic polypeptide
GSMCMPCFTTDHQMLRKCDDCCGGRGRGKCYGPQCLCRGAGAAGG

SEQ ID NO: 295 - protein, 45 aa, Artificial Sequence
  Description of Artificial Sequence: Synthetic polypeptide
GSMCMPCFTTDHQMLRLCDDCCGGRGRGKCYGPQCLCRGAGAAGG

SEQ ID NO: 296 - protein, 45 aa, Artificial Sequence
  Description of Artificial Sequence: Synthetic polypeptide
GSMCMPCFTTDHQMLRRCDDCCGGRGRGKCYGPQCLCRGAGAAGG

SEQ ID NO: 297 - protein, 45 aa, Artificial Sequence
  Description of Artificial Sequence: Synthetic polypeptide
GSMCMPCFTTDHQMLRKCDDCCGGKGRGLCYGPQCLCRGAGAAGG

SEQ ID NO: 298 - protein, 45 aa, Artificial Sequence
  Description of Artificial Sequence: Synthetic polypeptide
GSMCMPCFTTDHQMLRLCDDCCGGKGRGLCYGPQCLCRGAGAAGG

SEQ ID NO: 299 - protein, 45 aa, Artificial Sequence
  Description of Artificial Sequence: Synthetic polypeptide
GSMCMPCFTTDHQMLRRCDDCCGGKGRGLCYGPQCLCRGAGAAGG

SEQ ID NO: 300 - protein, 45 aa, Artificial Sequence
  Description of Artificial Sequence: Synthetic polypeptide
GSMCMPCFTTDHQMLRKCDDCCGGLGRGLCYGPQCLCRGAGAAGG

SEQ ID NO: 301 - protein, 45 aa, Artificial Sequence
  Description of Artificial Sequence: Synthetic polypeptide
GSMCMPCFTTDHQMLRLCDDCCGGLGRGLCYGPQCLCRGAGAAGG

SEQ ID NO: 302 - protein, 45 aa, Artificial Sequence
  Description of Artificial Sequence: Synthetic polypeptide
GSMCMPCFTTDHQMLRRCDDCCGGLGRGLCYGPQCLCRGAGAAGG

SEQ ID NO: 303 - protein, 45 aa, Artificial Sequence
  Description of Artificial Sequence: Synthetic polypeptide
GSMCMPCFTTDHQMLRKCDDCCGGRGRGLCYGPQCLCRGAGAAGG

SEQ ID NO: 304 - protein, 45 aa, Artificial Sequence
  Description of Artificial Sequence: Synthetic polypeptide
GSMCMPCFTTDHQMLRLCDDCCGGRGRGLCYGPQCLCRGAGAAGG

SEQ ID NO: 305 - protein, 45 aa, Artificial Sequence
  Description of Artificial Sequence: Synthetic polypeptide
GSMCMPCFTTDHQMLRRCDDCCGGRGRGLCYGPQCLCRGAGAAGG

SEQ ID NO: 306 - protein, 45 aa, Artificial Sequence
  Description of Artificial Sequence: Synthetic polypeptide
GSMCMPCFTTDHQMLRKCDDCCGGKGRGRCYGPQCLCRGAGAAGG

SEQ ID NO: 307 - protein, 45 aa, Artificial Sequence
  Description of Artificial Sequence: Synthetic polypeptide
GSMCMPCFTTDHQMLRLCDDCCGGKGRGRCYGPQCLCRGAGAAGG

SEQ ID NO: 308 - protein, 45 aa, Artificial Sequence
  Description of Artificial Sequence: Synthetic polypeptide
GSMCMPCFTTDHQMLRRCDDCCGGKGRGRCYGPQCLCRGAGAAGG

SEQ ID NO: 309 - protein, 45 aa, Artificial Sequence
  Description of Artificial Sequence: Synthetic polypeptide
GSMCMPCFTTDHQMLRKCDDCCGGLGRGRCYGPQCLCRGAGAAGG

SEQ ID NO: 310 - protein, 45 aa, Artificial Sequence
  Description of Artificial Sequence: Synthetic polypeptide
GSMCMPCFTTDHQMLRLCDDCCGGLGRGRCYGPQCLCRGAGAAGG

SEQ ID NO: 311 - protein, 45 aa, Artificial Sequence
  Description of Artificial Sequence: Synthetic polypeptide
GSMCMPCFTTDHQMLRRCDDCCGGLGRGRCYGPQCLCRGAGAAGG

SEQ ID NO: 312 - protein, 45 aa, Artificial Sequence
  Description of Artificial Sequence: Synthetic polypeptide
GSMCMPCFTTDHQMLRKCDDCCGGRGRGRCYGPQCLCRGAGAAGG

SEQ ID NO: 313 - protein, 45 aa, Artificial Sequence
  Description of Artificial Sequence: Synthetic polypeptide
GSMCMPCFTTDHQMLRLCDDCCGGRGRGRCYGPQCLCRGAGAAGG

SEQ ID NO: 314 - protein, 45 aa, Artificial Sequence
  Description of Artificial Sequence: Synthetic polypeptide
GSMCMPCFTTDHQMLRRCDDCCGGRGRGRCYGPQCLCRGAGAAGG

SEQ ID NO: 315 - protein, 45 aa, Artificial Sequence
  Description of Artificial Sequence: Synthetic polypeptide
GSKCMPCFTTDHQMLRRCDDCCGGRGRGRCYGPQCLCRGAGAAGG

SEQ ID NO: 316 - protein, 45 aa, Artificial Sequence
  Description of Artificial Sequence: Synthetic polypeptide
GSLCLPCFTTDHQLLRRCDDCCGGRGRGRCYGPQCLCRGAGAAGG

SEQ ID NO: 317 - protein, 45 aa, Artificial Sequence
  Description of Artificial Sequence: Synthetic polypeptide
GSKCLPCFTTDHQLLRRCDDCCGGRGRGRCYGPQCLCRGAGAAGG

SEQ ID NO: 318 - protein, 45 aa, Artificial Sequence
  Description of Artificial Sequence: Synthetic polypeptide
  MOD_RES (17)..(17): Citrulline
  MOD_RES (25)..(25): Citrulline
GSMCMPCFTTDHQMLRXCDDCCGGXGRGKCYGPQCLCRGAGAAGG

SEQ ID NO: 319 - protein, 45 aa, Artificial Sequence
  Description of Artificial Sequence: Synthetic polypeptide
  MOD_RES (17)..(17): Citrulline
  MOD_RES (25)..(25): Citrulline
  MOD_RES (29)..(29): Citrulline
GSMCMPCFTTDHQMLRXCDDCCGGXGRGXCYGPQCLCRGAGAAGG

SEQ ID NO: 320 - protein, 45 aa, Artificial Sequence
  Description of Artificial Sequence: Synthetic polypeptide
  MOD_RES (17)..(17): Citrulline
  MOD_RES (25)..(25): Citrulline
  MOD_RES (29)..(29): Citrulline
GSKCMPCFTTDHQMLRXCDDCCGGXGRGXCYGPQCLCRGAGAAGG

SEQ ID NO: 321 - protein, 45 aa, Artificial Sequence
  Description of Artificial Sequence: Synthetic polypeptide
  MOD_RES (17)..(17): Citrulline
  MOD_RES (25)..(25): Citrulline
GSLCLPCFTTDHQLLRXCDDCCGGXGRGKCYGPQCLCRGAGAAGG

SEQ ID NO: 322 - protein, 45 aa, Artificial Sequence
  Description of Artificial Sequence: Synthetic polypeptide
  MOD_RES (17)..(17): Citrulline
  MOD_RES (25)..(25): Citrulline
  MOD_RES (29)..(29): Citrulline
GSLCLPCFTTDHQLLRXCDDCCGGXGRGXCYGPQCLCRGAGAAGG

SEQ ID NO: 323 - protein, 45 aa, Artificial Sequence
  Description of Artificial Sequence: Synthetic polypeptide
  MOD_RES (17)..(17): Citrulline
  MOD_RES (25)..(25): Citrulline
  MOD_RES (29)..(29): Citrulline
GSKCLPCFTTDHQLLRXCDDCCGGXGRGXCYGPQCLCRGAGAAGG

SEQ ID NO: 324 - protein, 38 aa, Artificial Sequence
  Description of Artificial Sequence: Synthetic polypeptide
GSGCGPCFTTDHQGARKCDDCCGGKGRGKCYGPQCLCR

SEQ ID NO: 325 - protein, 38 aa, Artificial Sequence
  Description of Artificial Sequence: Synthetic polypeptide
GSGCGPCFTTDHQGARACDDCCGGKGRGKCYGPQCLCR

SEQ ID NO: 326 - protein, 38 aa, Artificial Sequence
  Description of Artificial Sequence: Synthetic polypeptide
GSGCGPCFTTDHQGARRCDDCCGGKGRGKCYGPQCLCR

SEQ ID NO: 327 - protein, 38 aa, Artificial Sequence
  Description of Artificial Sequence: Synthetic polypeptide
GSGCGPCFTTDHQGARKCDDCCGGAGRGKCYGPQCLCR

SEQ ID NO: 328 - protein, 38 aa, Artificial Sequence
  Description of Artificial Sequence: Synthetic polypeptide
GSGCGPCFTTDHQGARACDDCCGGAGRGKCYGPQCLCR

SEQ ID NO: 329 - protein, 38 aa, Artificial Sequence
  Description of Artificial Sequence: Synthetic polypeptide
GSGCGPCFTTDHQGARRCDDCCGGAGRGKCYGPQCLCR

SEQ ID NO: 330 - protein, 38 aa, Artificial Sequence
  Description of Artificial Sequence: Synthetic polypeptide
GSGCGPCFTTDHQGARKCDDCCGGRGRGKCYGPQCLCR

SEQ ID NO: 331 - protein, 38 aa, Artificial Sequence
  Description of Artificial Sequence: Synthetic polypeptide
GSGCGPCFTTDHQGARACDDCCGGRGRGKCYGPQCLCR

SEQ ID NO: 332 - protein, 38 aa, Artificial Sequence
  Description of Artificial Sequence: Synthetic polypeptide
GSGCGPCFTTDHQGARRCDDCCGGRGRGKCYGPQCLCR

SEQ ID NO: 333 - protein, 38 aa, Artificial Sequence
  Description of Artificial Sequence: Synthetic polypeptide
GSGCGPCFTTDHQGARKCDDCCGGKGRGACYGPQCLCR

SEQ ID NO: 334 - protein, 38 aa, Artificial Sequence
  Description of Artificial Sequence: Synthetic polypeptide
GSGCGPCFTTDHQGARACDDCCGGKGRGACYGPQCLCR

SEQ ID NO: 335 - protein, 38 aa, Artificial Sequence
  Description of Artificial Sequence: Synthetic polypeptide
GSGCGPCFTTDHQGARRCDDCCGGKGRGACYGPQCLCR

SEQ ID NO: 336 - protein, 38 aa, Artificial Sequence
  Description of Artificial Sequence: Synthetic polypeptide
GSGCGPCFTTDHQGARKCDDCCGGAGRGACYGPQCLCR

SEQ ID NO: 337 - protein, 38 aa, Artificial Sequence
  Description of Artificial Sequence: Synthetic polypeptide
GSGCGPCFTTDHQGARACDDCCGGAGRGACYGPQCLCR

SEQ ID NO: 338 - protein, 38 aa, Artificial Sequence
  Description of Artificial Sequence: Synthetic polypeptide
GSGCGPCFTTDHQGARRCDDCCGGAGRGACYGPQCLCR

SEQ ID NO: 339 - protein, 38 aa, Artificial Sequence
  Description of Artificial Sequence: Synthetic polypeptide
GSGCGPCFTTDHQGARKCDDCCGGRGRGACYGPQCLCR

SEQ ID NO: 340 - protein, 38 aa, Artificial Sequence
  Description of Artificial Sequence: Synthetic polypeptide
GSGCGPCFTTDHQGARACDDCCGGRGRGACYGPQCLCR

SEQ ID NO: 341 - protein, 38 aa, Artificial Sequence
  Description of Artificial Sequence: Synthetic polypeptide
GSGCGPCFTTDHQGARRCDDCCGGRGRGACYGPQCLCR

SEQ ID NO: 342 - protein, 38 aa, Artificial Sequence
  Description of Artificial Sequence: Synthetic polypeptide
GSGCGPCFTTDHQGARKCDDCCGGKGRGRCYGPQCLCR

SEQ ID NO: 343 - protein, 38 aa, Artificial Sequence
  Description of Artificial Sequence: Synthetic polypeptide
GSGCGPCFTTDHQGARACDDCCGGKGRGRCYGPQCLCR

SEQ ID NO: 344 - protein, 38 aa, Artificial Sequence
  Description of Artificial Sequence: Synthetic polypeptide
GSGCGPCFTTDHQGARRCDDCCGGKGRGRCYGPQCLCR

SEQ ID NO: 345 - protein, 38 aa, Artificial Sequence
  Description of Artificial Sequence: Synthetic polypeptide
GSGCGPCFTTDHQGARKCDDCCGGAGRGRCYGPQCLCR

SEQ ID NO: 346 - protein, 38 aa, Artificial Sequence
  Description of Artificial Sequence: Synthetic polypeptide
GSGCGPCFTTDHQGARACDDCCGGAGRGRCYGPQCLCR

SEQ ID NO: 347 - protein, 38 aa, Artificial Sequence
  Description of Artificial Sequence: Synthetic polypeptide
GSGCGPCFTTDHQGARRCDDCCGGAGRGRCYGPQCLCR

SEQ ID NO: 348 - protein, 38 aa, Artificial Sequence
  Description of Artificial Sequence: Synthetic polypeptide
GSGCGPCFTTDHQGARKCDDCCGGRGRGRCYGPQCLCR

SEQ ID NO: 349 - protein, 38 aa, Artificial Sequence
  Description of Artificial Sequence: Synthetic polypeptide
GSGCGPCFTTDHQGARACDDCCGGRGRGRCYGPQCLCR

SEQ ID NO: 350 - protein, 38 aa, Artificial Sequence
  Description of Artificial Sequence: Synthetic polypeptide
GSGCGPCFTTDHQGARRCDDCCGGRGRGRCYGPQCLCR

SEQ ID NO: 351 - protein, 38 aa, Artificial Sequence
  Description of Artificial Sequence: Synthetic polypeptide
GSKCGPCFTTDHQGARRCDDCCGGRGRGRCYGPQCLCR

SEQ ID NO: 352 - protein, 38 aa, Artificial Sequence
  Description of Artificial Sequence: Synthetic polypeptide
  MOD_RES (17)..(17): Citrulline
  MOD_RES (25)..(25): Citrulline
GSGCGPCFTTDHQGARXCDDCCGGXGRGKCYGPQCLCR

SEQ ID NO: 353 - protein, 38 aa, Artificial Sequence
  Description of Artificial Sequence: Synthetic polypeptide
  MOD_RES (17)..(17): Citrulline
  MOD_RES (25)..(25): Citrulline
  MOD_RES (29)..(29): Citrulline
GSGCGPCFTTDHQGARXCDDCCGGXGRGXCYGPQCLCR

SEQ ID NO: 354 - protein, 38 aa, Artificial Sequence
  Description of Artificial Sequence: Synthetic polypeptide
  MOD_RES (17)..(17): Citrulline
  MOD_RES (25)..(25): Citrulline
  MOD_RES (29)..(29): Citrulline
GSKCGPCFTTDHQGARXCDDCCGGXGRGXCYGPQCLCR

SEQ ID NO: 355 - protein, 38 aa, Artificial Sequence
  Description of Artificial Sequence: Synthetic polypeptide
GSACAPCFTTDHQAARACDDCCGGKGRGKCYGPQCLCR

SEQ ID NO: 356 - protein, 38 aa, Artificial Sequence
  Description of Artificial Sequence: Synthetic polypeptide
GSACAPCFTTDHQAARRCDDCCGGKGRGKCYGPQCLCR

SEQ ID NO: 357 - protein, 38 aa, Artificial Sequence
  Description of Artificial Sequence: Synthetic polypeptide
GSACAPCFTTDHQAARKCDDCCGGAGRGKCYGPQCLCR

SEQ ID NO: 358 - protein, 38 aa, Artificial Sequence
  Description of Artificial Sequence: Synthetic polypeptide
GSACAPCFTTDHQAARACDDCCGGAGRGKCYGPQCLCR

SEQ ID NO: 359 - protein, 38 aa, Artificial Sequence
  Description of Artificial Sequence: Synthetic polypeptide
GSACAPCFTTDHQAARRCDDCCGGAGRGKCYGPQCLCR

SEQ ID NO: 360 - protein, 38 aa, Artificial Sequence
  Description of Artificial Sequence: Synthetic polypeptide
GSACAPCFTTDHQAARKCDDCCGGRGRGKCYGPQCLCR

SEQ ID NO: 361 - protein, 38 aa, Artificial Sequence
  Description of Artificial Sequence: Synthetic polypeptide
GSACAPCFTTDHQAARACDDCCGGRGRGKCYGPQCLCR

SEQ ID NO: 362 - protein, 38 aa, Artificial Sequence
  Description of Artificial Sequence: Synthetic polypeptide
GSACAPCFTTDHQAARKCDDCCGGKGRGACYGPQCLCR

SEQ ID NO: 363 - protein, 38 aa, Artificial Sequence
  Description of Artificial Sequence: Synthetic polypeptide
GSACAPCFTTDHQAARACDDCCGGKGRGACYGPQCLCR

SEQ ID NO: 364 - protein, 38 aa, Artificial Sequence
  Description of Artificial Sequence: Synthetic polypeptide
GSACAPCFTTDHQAARRCDDCCGGKGRGACYGPQCLCR

SEQ ID NO: 365 - protein, 38 aa, Artificial Sequence
  Description of Artificial Sequence: Synthetic polypeptide
GSACAPCFTTDHQAARKCDDCCGGAGRGACYGPQCLCR

SEQ ID NO: 366 - protein, 38 aa, Artificial Sequence
  Description of Artificial Sequence: Synthetic polypeptide
GSACAPCFTTDHQAARACDDCCGGAGRGACYGPQCLCR

SEQ ID NO: 367 - protein, 38 aa, Artificial Sequence
  Description of Artificial Sequence: Synthetic polypeptide
GSACAPCFTTDHQAARRCDDCCGGAGRGACYGPQCLCR

SEQ ID NO: 368 - protein, 38 aa, Artificial Sequence
  Description of Artificial Sequence: Synthetic polypeptide
GSACAPCFTTDHQAARKCDDCCGGRGRGACYGPQCLCR

SEQ ID NO: 369 - protein, 38 aa, Artificial Sequence
  Description of Artificial Sequence: Synthetic polypeptide
GSACAPCFTTDHQAARACDDCCGGRGRGACYGPQCLCR

SEQ ID NO: 370 - protein, 38 aa, Artificial Sequence
  Description of Artificial Sequence: Synthetic polypeptide
GSACAPCFTTDHQAARRCDDCCGGRGRGACYGPQCLCR

SEQ ID NO: 371 - protein, 38 aa, Artificial Sequence
  Description of Artificial Sequence: Synthetic polypeptide
GSACAPCFTTDHQAARKCDDCCGGKGRGRCYGPQCLCR

SEQ ID NO: 372 - protein, 38 aa, Artificial Sequence
  Description of Artificial Sequence: Synthetic polypeptide
GSACAPCFTTDHQAARACDDCCGGKGRGRCYGPQCLCR

SEQ ID NO: 373 - protein, 38 aa, Artificial Sequence
  Description of Artificial Sequence: Synthetic polypeptide
GSACAPCFTTDHQAARRCDDCCGGKGRGRCYGPQCLCR

SEQ ID NO: 374 - protein, 38 aa, Artificial Sequence
  Description of Artificial Sequence: Synthetic polypeptide
GSACAPCFTTDHQAARKCDDCCGGAGRGRCYGPQCLCR

SEQ ID NO: 375 - protein, 38 aa, Artificial Sequence
  Description of Artificial Sequence: Synthetic polypeptide
GSACAPCFTTDHQAARACDDCCGGAGRGRCYGPQCLCR

SEQ ID NO: 376 - protein, 38 aa, Artificial Sequence
  Description of Artificial Sequence: Synthetic polypeptide
GSACAPCFTTDHQAARRCDDCCGGAGRGRCYGPQCLCR

SEQ ID NO: 377 - protein, 38 aa, Artificial Sequence
  Description of Artificial Sequence: Synthetic polypeptide
GSACAPCFTTDHQAARKCDDCCGGRGRGRCYGPQCLCR

SEQ ID NO: 378 - protein, 38 aa, Artificial Sequence
  Description of Artificial Sequence: Synthetic polypeptide
GSACAPCFTTDHQAARACDDCCGGRGRGRCYGPQCLCR

SEQ ID NO: 379 - protein, 38 aa, Artificial Sequence
  Description of Artificial Sequence: Synthetic polypeptide
GSICIPCFTTDHQIARKCDDCCGGKGRGKCYGPQCLCR

SEQ ID NO: 380 - protein, 38 aa, Artificial Sequence
  Description of Artificial Sequence: Synthetic polypeptide
GSICIPCFTTDHQIARACDDCCGGKGRGKCYGPQCLCR

SEQ ID NO: 381 - protein, 38 aa, Artificial Sequence
  Description of Artificial Sequence: Synthetic polypeptide
GSICIPCFTTDHQIARRCDDCCGGKGRGKCYGPQCLCR

SEQ ID NO: 382 - protein, 38 aa, Artificial Sequence
  Description of Artificial Sequence: Synthetic polypeptide
GSICIPCFTTDHQIARKCDDCCGGAGRGKCYGPQCLCR

SEQ ID NO: 383 - protein, 38 aa, Artificial Sequence
  Description of Artificial Sequence: Synthetic polypeptide
GSICIPCFTTDHQIARACDDCCGGAGRGKCYGPQCLCR

SEQ ID NO: 384 - protein, 38 aa, Artificial Sequence
  Description of Artificial Sequence: Synthetic polypeptide
GSICIPCFTTDHQIARRCDDCCGGAGRGKCYGPQCLCR

SEQ ID NO: 385 - protein, 38 aa, Artificial Sequence
  Description of Artificial Sequence: Synthetic polypeptide
GSICIPCFTTDHQIARKCDDCCGGRGRGKCYGPQCLCR

SEQ ID NO: 386 - protein, 38 aa, Artificial Sequence
  Description of Artificial Sequence: Synthetic polypeptide
GSICIPCFTTDHQIARACDDCCGGRGRGKCYGPQCLCR

SEQ ID NO: 387 - protein, 38 aa, Artificial Sequence
  Description of Artificial Sequence: Synthetic polypeptide
GSICIPCFTTDHQIARKCDDCCGGKGRGACYGPQCLCR

SEQ ID NO: 388 - protein, 38 aa, Artificial Sequence
  Description of Artificial Sequence: Synthetic polypeptide
GSICIPCFTTDHQIARACDDCCGGKGRGACYGPQCLCR

SEQ ID NO: 389 - protein, 38 aa, Artificial Sequence
  Description of Artificial Sequence: Synthetic polypeptide
GSICIPCFTTDHQIARRCDDCCGGKGRGACYGPQCLCR

SEQ ID NO: 390 - protein, 38 aa, Artificial Sequence
  Description of Artificial Sequence: Synthetic polypeptide
GSICIPCFTTDHQIARKCDDCCGGAGRGACYGPQCLCR

SEQ ID NO: 391 - protein, 38 aa, Artificial Sequence
  Description of Artificial Sequence: Synthetic polypeptide
GSICIPCFTTDHQIARACDDCCGGAGRGACYGPQCLCR

SEQ ID NO: 392 - protein, 38 aa, Artificial Sequence
  Description of Artificial Sequence: Synthetic polypeptide
GSICIPCFTTDHQIARRCDDCCGGAGRGACYGPQCLCR

SEQ ID NO: 393 - protein, 38 aa, Artificial Sequence
  Description of Artificial Sequence: Synthetic polypeptide
GSICIPCFTTDHQIARKCDDCCGGRGRGACYGPQCLCR

SEQ ID NO: 394 - protein, 38 aa, Artificial Sequence
  Description of Artificial Sequence: Synthetic polypeptide
GSICIPCFTTDHQIARACDDCCGGRGRGACYGPQCLCR

SEQ ID NO: 395 - protein, 38 aa, Artificial Sequence
  Description of Artificial Sequence: Synthetic polypeptide
GSICIPCFTTDHQIARRCDDCCGGRGRGACYGPQCLCR

SEQ ID NO: 396 - protein, 38 aa, Artificial Sequence
  Description of Artificial Sequence: Synthetic polypeptide
GSICIPCFTTDHQIARKCDDCCGGKGRGRCYGPQCLCR

SEQ ID NO: 397 - protein, 38 aa, Artificial Sequence
  Description of Artificial Sequence: Synthetic polypeptide
GSICIPCFTTDHQIARACDDCCGGKGRGRCYGPQCLCR

SEQ ID NO: 398 - protein, 38 aa, Artificial Sequence
  Description of Artificial Sequence: Synthetic polypeptide
GSICIPCFTTDHQIARRCDDCCGGKGRGRCYGPQCLCR

SEQ ID NO: 399 - protein, 38 aa, Artificial Sequence
  Description of Artificial Sequence: Synthetic polypeptide
GSICIPCFTTDHQIARKCDDCCGGAGRGRCYGPQCLCR

SEQ ID NO: 400 - protein, 38 aa, Artificial Sequence
  Description of Artificial Sequence: Synthetic polypeptide
GSICIPCFTTDHQIARACDDCCGGAGRGRCYGPQCLCR

SEQ ID NO: 401 - protein, 38 aa, Artificial Sequence
  Description of Artificial Sequence: Synthetic polypeptide
GSICIPCFTTDHQIARRCDDCCGGAGRGRCYGPQCLCR

SEQ ID NO: 402 - protein, 38 aa, Artificial Sequence
  Description of Artificial Sequence: Synthetic polypeptide
GSICIPCFTTDHQIARKCDDCCGGRGRGRCYGPQCLCR

SEQ ID NO: 403 - protein, 38 aa, Artificial Sequence
  Description of Artificial Sequence: Synthetic polypeptide
GSICIPCFTTDHQIARACDDCCGGRGRGRCYGPQCLCR

SEQ ID NO: 404 - protein, 38 aa, Artificial Sequence
  Description of Artificial Sequence: Synthetic polypeptide
GSICIPCFTTDHQIARRCDDCCGGRGRGRCYGPQCLCR

SEQ ID NO: 405 - protein, 38 aa, Artificial Sequence
  Description of Artificial Sequence: Synthetic polypeptide
GSKCIPCFTTDHQIARRCDDCCGGRGRGRCYGPQCLCR

SEQ ID NO: 406 - protein, 38 aa, Artificial Sequence
  Description of Artificial Sequence: Synthetic polypeptide
  MOD_RES (17)..(17): Citrulline
  MOD_RES (25)..(25): Citrulline
GSICIPCFTTDHQIARXCDDCCGGXGRGKCYGPQCLCR

SEQ ID NO: 407 - protein, 38 aa, Artificial Sequence
  Description of Artificial Sequence: Synthetic polypeptide
  MOD_RES (17)..(17): Citrulline
  MOD_RES (25)..(25): Citrulline
  MOD_RES (29)..(29): Citrulline
GSICIPCFTTDHQIARXCDDCCGGXGRGXCYGPQCLCR

SEQ ID NO: 408 - protein, 38 aa, Artificial Sequence
  Description of Artificial Sequence: Synthetic polypeptide
  MOD_RES (17)..(17): Citrulline
  MOD_RES (25)..(25): Citrulline
  MOD_RES (29)..(29): Citrulline
GSKCIPCFTTDHQIARXCDDCCGGXGRGXCYGPQCLCR

SEQ ID NO: 409 - protein, 38 aa, Artificial Sequence
  Description of Artificial Sequence: Synthetic polypeptide
GSTCTPCFTTDHQTARKCDDCCGGKGRGKCYGPQCLCR

SEQ ID NO: 410 - protein, 38 aa, Artificial Sequence
  Description of Artificial Sequence: Synthetic polypeptide
GSTCTPCFTTDHQTARACDDCCGGKGRGKCYGPQCLCR

SEQ ID NO: 411 - protein, 38 aa, Artificial Sequence
  Description of Artificial Sequence: Synthetic polypeptide
GSTCTPCFTTDHQTARRCDDCCGGKGRGKCYGPQCLCR

SEQ ID NO: 412 - protein, 38 aa, Artificial Sequence
  Description of Artificial Sequence: Synthetic polypeptide
GSTCTPCFTTDHQTARKCDDCCGGAGRGKCYGPQCLCR

SEQ ID NO: 413 - protein, 38 aa, Artificial Sequence
  Description of Artificial Sequence: Synthetic polypeptide
GSTCTPCFTTDHQTARACDDCCGGAGRGKCYGPQCLCR

SEQ ID NO: 414 - protein, 38 aa, Artificial Sequence
  Description of Artificial Sequence: Synthetic polypeptide
GSTCTPCFTTDHQTARRCDDCCGGAGRGKCYGPQCLCR

SEQ ID NO: 415 - protein, 38 aa, Artificial Sequence
  Description of Artificial Sequence: Synthetic polypeptide
GSTCTPCFTTDHQTARKCDDCCGGRGRGKCYGPQCLCR

SEQ ID NO: 416 - protein, 38 aa, Artificial Sequence
  Description of Artificial Sequence: Synthetic polypeptide
GSTCTPCFTTDHQTARACDDCCGGRGRGKCYGPQCLCR

SEQ ID NO: 417 - protein, 38 aa, Artificial Sequence
  Description of Artificial Sequence: Synthetic polypeptide
GSTCTPCFTTDHQTARRCDDCCGGRGRGKCYGPQCLCR

SEQ ID NO: 418 - protein, 38 aa, Artificial Sequence
  Description of Artificial Sequence: Synthetic polypeptide
GSTCTPCFTTDHQTARKCDDCCGGKGRGACYGPQCLCR

SEQ ID NO: 419 - protein, 38 aa, Artificial Sequence
  Description of Artificial Sequence: Synthetic polypeptide
GSTCTPCFTTDHQTARACDDCCGGKGRGACYGPQCLCR

SEQ ID NO: 420 - protein, 38 aa, Artificial Sequence
  Description of Artificial Sequence: Synthetic polypeptide
GSTCTPCFTTDHQTARRCDDCCGGKGRGACYGPQCLCR

SEQ ID NO: 421 - protein, 38 aa, Artificial Sequence
  Description of Artificial Sequence: Synthetic polypeptide
GSTCTPCFTTDHQTARKCDDCCGGAGRGACYGPQCLCR

SEQ ID NO: 422 - protein, 38 aa, Artificial Sequence
  Description of Artificial Sequence: Synthetic polypeptide
GSTCTPCFTTDHQTARACDDCCGGAGRGACYGPQCLCR

SEQ ID NO: 423 - protein, 38 aa, Artificial Sequence
  Description of Artificial Sequence: Synthetic polypeptide
GSTCTPCFTTDHQTARRCDDCCGGAGRGACYGPQCLCR

SEQ ID NO: 424 - protein, 38 aa, Artificial Sequence
  Description of Artificial Sequence: Synthetic polypeptide
GSTCTPCFTTDHQTARKCDDCCGGRGRGACYGPQCLCR

SEQ ID NO: 425 - protein, 38 aa, Artificial Sequence
  Description of Artificial Sequence: Synthetic polypeptide
GSTCTPCFTTDHQTARACDDCCGGRGRGACYGPQCLCR

SEQ ID NO: 426 - protein, 38 aa, Artificial Sequence
  Description of Artificial Sequence: Synthetic polypeptide
GSTCTPCFTTDHQTARRCDDCCGGRGRGACYGPQCLCR

SEQ ID NO: 427 - protein, 38 aa, Artificial Sequence
  Description of Artificial Sequence: Synthetic polypeptide
GSTCTPCFTTDHQTARKCDDCCGGKGRGRCYGPQCLCR

SEQ ID NO: 428 - protein, 38 aa, Artificial Sequence
  Description of Artificial Sequence: Synthetic polypeptide
GSTCTPCFTTDHQTARACDDCCGGKGRGRCYGPQCLCR

SEQ ID NO: 429 - protein, 38 aa, Artificial Sequence
  Description of Artificial Sequence: Synthetic polypeptide
GSTCTPCFTTDHQTARRCDDCCGGKGRGRCYGPQCLCR

SEQ ID NO: 430 - protein, 38 aa, Artificial Sequence
  Description of Artificial Sequence: Synthetic polypeptide
GSTCTPCFTTDHQTARKCDDCCGGAGRGRCYGPQCLCR

SEQ ID NO: 431 - protein, 38 aa, Artificial Sequence
  Description of Artificial Sequence: Synthetic polypeptide
GSTCTPCFTTDHQTARACDDCCGGAGRGRCYGPQCLCR

SEQ ID NO: 432 - protein, 38 aa, Artificial Sequence
  Description of Artificial Sequence: Synthetic polypeptide
GSTCTPCFTTDHQTARRCDDCCGGAGRGRCYGPQCLCR

SEQ ID NO: 433 - protein, 38 aa, Artificial Sequence
  Description of Artificial Sequence: Synthetic polypeptide
GSTCTPCFTTDHQTARKCDDCCGGRGRGRCYGPQCLCR

SEQ ID NO: 434 - protein, 38 aa, Artificial Sequence
  Description of Artificial Sequence: Synthetic polypeptide
GSTCTPCFTTDHQTARACDDCCGGRGRGRCYGPQCLCR

SEQ ID NO: 435 - protein, 38 aa, Artificial Sequence
  Description of Artificial Sequence: Synthetic polypeptide
GSTCTPCFTTDHQTARRCDDCCGGRGRGRCYGPQCLCR

SEQ ID NO: 436 - protein, 38 aa, Artificial Sequence
  Description of Artificial Sequence: Synthetic polypeptide
GSKCTPCFTTDHQTARRCDDCCGGRGRGRCYGPQCLCR

SEQ ID NO: 437 - protein, 38 aa, Artificial Sequence
  Description of Artificial Sequence: Synthetic polypeptide
  MOD_RES (17)..(17): Citrulline
  MOD_RES (25)..(25): Citrulline
GSTCTPCFTTDHQTARXCDDCCGGXGRGKCYGPQCLCR

SEQ ID NO: 438 - protein, 38 aa, Artificial Sequence
  Description of Artificial Sequence: Synthetic polypeptide
  MOD_RES (17)..(17): Citrulline
  MOD_RES (25)..(25): Citrulline
  MOD_RES (29)..(29): Citrulline
GSTCTPCFTTDHQTARXCDDCCGGXGRGXCYGPQCLCR

SEQ ID NO: 439 - protein, 38 aa, Artificial Sequence
  Description of Artificial Sequence: Synthetic polypeptide
  MOD_RES (17)..(17): Citrulline
  MOD_RES (25)..(25): Citrulline
  MOD_RES (29)..(29): Citrulline
GSKCTPCFTTDHQTARXCDDCCGGXGRGXCYGPQCLCR

SEQ ID NO: 440 - protein, 38 aa, Artificial Sequence
  Description of Artificial Sequence: Synthetic polypeptide
GSVCVPCFTTDHQVARKCDDCCGGKGRGKCYGPQCLCR

SEQ ID NO: 441 - protein, 38 aa, Artificial Sequence
  Description of Artificial Sequence: Synthetic polypeptide
GSVCVPCFTTDHQVARACDDCCGGKGRGKCYGPQCLCR

SEQ ID NO: 442 - protein, 38 aa, Artificial Sequence
  Description of Artificial Sequence: Synthetic polypeptide
GSVCVPCFTTDHQVARRCDDCCGGKGRGKCYGPQCLCR

SEQ ID NO: 443 - protein, 38 aa, Artificial Sequence
  Description of Artificial Sequence: Synthetic polypeptide
GSVCVPCFTTDHQVARKCDDCCGGAGRGKCYGPQCLCR

SEQ ID NO: 444 - protein, 38 aa, Artificial Sequence
  Description of Artificial Sequence: Synthetic polypeptide
GSVCVPCFTTDHQVARACDDCCGGAGRGKCYGPQCLCR

SEQ ID NO: 445 - protein, 38 aa, Artificial Sequence
  Description of Artificial Sequence: Synthetic polypeptide
GSVCVPCFTTDHQVARRCDDCCGGAGRGKCYGPQCLCR

SEQ ID NO: 446 - protein, 38 aa, Artificial Sequence
  Description of Artificial Sequence: Synthetic polypeptide
GSVCVPCFTTDHQVARKCDDCCGGRGRGKCYGPQCLCR

SEQ ID NO: 447 - protein, 38 aa, Artificial Sequence
  Description of Artificial Sequence: Synthetic polypeptide
GSVCVPCFTTDHQVARACDDCCGGRGRGKCYGPQCLCR

SEQ ID NO: 448 - protein, 38 aa, Artificial Sequence
  Description of Artificial Sequence: Synthetic polypeptide
GSVCVPCFTTDHQVARRCDDCCGGRGRGKCYGPQCLCR

SEQ ID NO: 449 - protein, 38 aa, Artificial Sequence
  Description of Artificial Sequence: Synthetic polypeptide
GSVCVPCFTTDHQVARKCDDCCGGKGRGACYGPQCLCR

SEQ ID NO: 450 - protein, 38 aa, Artificial Sequence
  Description of Artificial Sequence: Synthetic polypeptide
GSVCVPCFTTDHQVARACDDCCGGKGRGACYGPQCLCR

SEQ ID NO: 451 - protein, 38 aa, Artificial Sequence
  Description of Artificial Sequence: Synthetic polypeptide
GSVCVPCFTTDHQVARRCDDCCGGKGRGACYGPQCLCR

SEQ ID NO: 452 - protein, 38 aa, Artificial Sequence
  Description of Artificial Sequence: Synthetic polypeptide
GSVCVPCFTTDHQVARKCDDCCGGAGRGACYGPQCLCR

SEQ ID NO: 453 - protein, 38 aa, Artificial Sequence
  Description of Artificial Sequence: Synthetic polypeptide
GSVCVPCFTTDHQVARACDDCCGGAGRGACYGPQCLCR

SEQ ID NO: 454 - protein, 38 aa, Artificial Sequence
  Description of Artificial Sequence: Synthetic polypeptide
GSVCVPCFTTDHQVARRCDDCCGGAGRGACYGPQCLCR

SEQ ID NO: 455 - protein, 38 aa, Artificial Sequence
  Description of Artificial Sequence: Synthetic polypeptide
GSVCVPCFTTDHQVARKCDDCCGGRGRGACYGPQCLCR

SEQ ID NO: 456 - protein, 38 aa, Artificial Sequence
  Description of Artificial Sequence: Synthetic polypeptide
GSVCVPCFTTDHQVARACDDCCGGRGRGACYGPQCLCR

SEQ ID NO: 457 - protein, 38 aa, Artificial Sequence
  Description of Artificial Sequence: Synthetic polypeptide
GSVCVPCFTTDHQVARRCDDCCGGRGRGACYGPQCLCR

SEQ ID NO: 458 - protein, 38 aa, Artificial Sequence
  Description of Artificial Sequence: Synthetic polypeptide
GSVCVPCFTTDHQVARKCDDCCGGKGRGRCYGPQCLCR

SEQ ID NO: 459 - protein, 38 aa, Artificial Sequence
  Description of Artificial Sequence: Synthetic polypeptide
GSVCVPCFTTDHQVARACDDCCGGKGRGRCYGPQCLCR

SEQ ID NO: 460 - protein, 38 aa, Artificial Sequence
  Description of Artificial Sequence: Synthetic polypeptide
GSVCVPCFTTDHQVARRCDDCCGGKGRGRCYGPQCLCR

SEQ ID NO: 461 - protein, 38 aa, Artificial Sequence
  Description of Artificial Sequence: Synthetic polypeptide
GSVCVPCFTTDHQVARKCDDCCGGAGRGRCYGPQCLCR

SEQ ID NO: 462 - protein, 38 aa, Artificial Sequence
  Description of Artificial Sequence: Synthetic polypeptide
GSVCVPCFTTDHQVARACDDCCGGAGRGRCYGPQCLCR

SEQ ID NO: 463 - protein, 38 aa, Artificial Sequence
  Description of Artificial Sequence: Synthetic polypeptide
GSVCVPCFTTDHQVARRCDDCCGGAGRGRCYGPQCLCR

SEQ ID NO: 464 - protein, 38 aa, Artificial Sequence
  Description of Artificial Sequence: Synthetic polypeptide
GSVCVPCFTTDHQVARKCDDCCGGRGRGRCYGPQCLCR

SEQ ID NO: 465 - protein, 38 aa, Artificial Sequence
  Description of Artificial Sequence: Synthetic polypeptide
GSVCVPCFTTDHQVARACDDCCGGRGRGRCYGPQCLCR

SEQ ID NO: 466 - protein, 38 aa, Artificial Sequence
  Description of Artificial Sequence: Synthetic polypeptide
GSVCVPCFTTDHQVARRCDDCCGGRGRGRCYGPQCLCR

SEQ ID NO: 467 - protein, 38 aa, Artificial Sequence
  Description of Artificial Sequence: Synthetic polypeptide
GSKCVPCFTTDHQVARRCDDCCGGRGRGRCYGPQCLCR

SEQ ID NO: 468 - protein, 38 aa, Artificial Sequence
  Description of Artificial Sequence: Synthetic polypeptide
  MOD_RES (17)..(17): Citrulline
  MOD_RES (25)..(25): Citrulline
GSVCVPCFTTDHQVARXCDDCCGGXGRGKCYGPQCLCR

SEQ ID NO: 469 - protein, 38 aa, Artificial Sequence
  Description of Artificial Sequence: Synthetic polypeptide
  MOD_RES (17)..(17): Citrulline
  MOD_RES (25)..(25): Citrulline
  MOD_RES (29)..(29): Citrulline
GSVCVPCFTTDHQVARXCDDCCGGXGRGXCYGPQCLCR

SEQ ID NO: 470 - protein, 38 aa, Artificial Sequence
  Description of Artificial Sequence: Synthetic polypeptide
  MOD_RES (17)..(17): Citrulline
  MOD_RES (25)..(25): Citrulline
  MOD_RES (29)..(29): Citrulline
GSKCVPCFTTDHQVARXCDDCCGGXGRGXCYGPQCLCR

SEQ ID NO: 471 - protein, 38 aa, Artificial Sequence
  Description of Artificial Sequence: Synthetic polypeptide
GSLCLPCFTTDHQLARKCDDCCGGKGRGKCYGPQCLCR

SEQ ID NO: 472 - protein, 38 aa, Artificial Sequence
  Description of Artificial Sequence: Synthetic polypeptide
GSLCLPCFTTDHQLARACDDCCGGKGRGKCYGPQCLCR

SEQ ID NO: 473 - protein, 38 aa, Artificial Sequence
  Description of Artificial Sequence: Synthetic polypeptide
GSLCLPCFTTDHQLARRCDDCCGGKGRGKCYGPQCLCR

SEQ ID NO: 474 - protein, 38 aa, Artificial Sequence
  Description of Artificial Sequence: Synthetic polypeptide
GSLCLPCFTTDHQLARKCDDCCGGAGRGKCYGPQCLCR

SEQ ID NO: 475 - protein, 38 aa, Artificial Sequence
  Description of Artificial Sequence: Synthetic polypeptide
GSLCLPCFTTDHQLARACDDCCGGAGRGKCYGPQCLCR

SEQ ID NO: 476 - protein, 38 aa, Artificial Sequence
  Description of Artificial Sequence: Synthetic polypeptide
GSLCLPCFTTDHQLARRCDDCCGGAGRGKCYGPQCLCR

SEQ ID NO: 477 - protein, 38 aa, Artificial Sequence
  Description of Artificial Sequence: Synthetic polypeptide
GSLCLPCFTTDHQLARKCDDCCGGRGRGKCYGPQCLCR

SEQ ID NO: 478 - protein, 38 aa, Artificial Sequence
  Description of Artificial Sequence: Synthetic polypeptide
GSLCLPCFTTDHQLARACDDCCGGRGRGKCYGPQCLCR

SEQ ID NO: 479 - protein, 38 aa, Artificial Sequence
  Description of Artificial Sequence: Synthetic polypeptide
GSLCLPCFTTDHQLARRCDDCCGGRGRGKCYGPQCLCR

SEQ ID NO: 480 - protein, 38 aa, Artificial Sequence
  Description of Artificial Sequence: Synthetic polypeptide
GSLCLPCFTTDHQLARKCDDCCGGKGRGACYGPQCLCR

SEQ ID NO: 481 - protein, 38 aa, Artificial Sequence
  Description of Artificial Sequence: Synthetic polypeptide
GSLCLPCFTTDHQLARACDDCCGGKGRGACYGPQCLCR

SEQ ID NO: 482 - protein, 38 aa, Artificial Sequence
  Description of Artificial Sequence: Synthetic polypeptide
GSLCLPCFTTDHQLARRCDDCCGGKGRGACYGPQCLCR

SEQ ID NO: 483 - protein, 38 aa, Artificial Sequence
  Description of Artificial Sequence: Synthetic polypeptide
GSLCLPCFTTDHQLARKCDDCCGGAGRGACYGPQCLCR

SEQ ID NO: 484 - protein, 38 aa, Artificial Sequence
  Description of Artificial Sequence: Synthetic polypeptide
GSLCLPCFTTDHQLARACDDCCGGAGRGACYGPQCLCR

SEQ ID NO: 485 - protein, 38 aa, Artificial Sequence
  Description of Artificial Sequence: Synthetic polypeptide
GSLCLPCFTTDHQLARRCDDCCGGAGRGACYGPQCLCR

SEQ ID NO: 486 - protein, 38 aa, Artificial Sequence
  Description of Artificial Sequence: Synthetic polypeptide
GSLCLPCFTTDHQLARKCDDCCGGRGRGACYGPQCLCR

SEQ ID NO: 487 - protein, 38 aa, Artificial Sequence
  Description of Artificial Sequence: Synthetic polypeptide
GSLCLPCFTTDHQLARACDDCCGGRGRGACYGPQCLCR

SEQ ID NO: 488 - protein, 38 aa, Artificial Sequence
  Description of Artificial Sequence: Synthetic polypeptide
GSLCLPCFTTDHQLARRCDDCCGGRGRGACYGPQCLCR

SEQ ID NO: 489 - protein, 38 aa, Artificial Sequence
  Description of Artificial Sequence: Synthetic polypeptide
GSLCLPCFTTDHQLARKCDDCCGGKGRGRCYGPQCLCR

SEQ ID NO: 490 - protein, 38 aa, Artificial Sequence
  Description of Artificial Sequence: Synthetic polypeptide
GSLCLPCFTTDHQLARACDDCCGGKGRGRCYGPQCLCR

SEQ ID NO: 491 - protein, 38 aa, Artificial Sequence
  Description of Artificial Sequence: Synthetic polypeptide
GSLCLPCFTTDHQLARRCDDCCGGKGRGRCYGPQCLCR

SEQ ID NO: 492 - protein, 38 aa, Artificial Sequence
  Description of Artificial Sequence: Synthetic polypeptide
GSLCLPCFTTDHQLARKCDDCCGGAGRGRCYGPQCLCR

SEQ ID NO: 493 - protein, 38 aa, Artificial Sequence
  Description of Artificial Sequence: Synthetic polypeptide
GSLCLPCFTTDHQLARACDDCCGGAGRGRCYGPQCLCR

SEQ ID NO: 494 - protein, 38 aa, Artificial Sequence
  Description of Artificial Sequence: Synthetic polypeptide
GSLCLPCFTTDHQLARRCDDCCGGAGRGRCYGPQCLCR

SEQ ID NO: 495 - protein, 38 aa, Artificial Sequence
  Description of Artificial Sequence: Synthetic polypeptide
GSLCLPCFTTDHQLARKCDDCCGGRGRGRCYGPQCLCR

SEQ ID NO: 496 - protein, 38 aa, Artificial Sequence
  Description of Artificial Sequence: Synthetic polypeptide
GSLCLPCFTTDHQLARACDDCCGGRGRGRCYGPQCLCR

SEQ ID NO: 497 - protein, 38 aa, Artificial Sequence
  Description of Artificial Sequence: Synthetic polypeptide
GSLCLPCFTTDHQLARRCDDCCGGRGRGRCYGPQCLCR

SEQ ID NO: 498 - protein, 38 aa, Artificial Sequence
  Description of Artificial Sequence: Synthetic polypeptide
GSKCLPCFTTDHQLARRCDDCCGGRGRGRCYGPQCLCR

SEQ ID NO: 499 - protein, 38 aa, Artificial Sequence
  Description of Artificial Sequence: Synthetic polypeptide
  MOD_RES (17)..(17): Citrulline
  MOD_RES (25)..(25): Citrulline
GSLCLPCFTTDHQLARXCDDCCGGXGRGKCYGPQCLCR

SEQ ID NO: 500 - protein, 38 aa, Artificial Sequence
  Description of Artificial Sequence: Synthetic polypeptide
  MOD_RES (17)..(17): Citrulline
  MOD_RES (25)..(25): Citrulline
  MOD_RES (29)..(29): Citrulline
GSLCLPCFTTDHQLARXCDDCCGGXGRGXCYGPQCLCR

SEQ ID NO: 501 - protein, 38 aa, Artificial Sequence
  Description of Artificial Sequence: Synthetic polypeptide
  MOD_RES (17)..(17): Citrulline
  MOD_RES (25)..(25): Citrulline
  MOD_RES (29)..(29): Citrulline
GSKCLPCFTTDHQLARXCDDCCGGXGRGXCYGPQCLCR

SEQ ID NO: 502 - protein, 38 aa, Artificial Sequence
  Description of Artificial Sequence: Synthetic polypeptide
GSSCSPCFTTDHQSARKCDDCCGGKGRGKCYGPQCLCR

SEQ ID NO: 503 - protein, 38 aa, Artificial Sequence
  Description of Artificial Sequence: Synthetic polypeptide
GSSCSPCFTTDHQSARACDDCCGGKGRGKCYGPQCLCR

SEQ ID NO: 504 - protein, 38 aa, Artificial Sequence
  Description of Artificial Sequence: Synthetic polypeptide
GSSCSPCFTTDHQSARRCDDCCGGKGRGKCYGPQCLCR

SEQ ID NO: 505 - protein, 38 aa, Artificial Sequence
  Description of Artificial Sequence: Synthetic polypeptide
GSSCSPCFTTDHQSARKCDDCCGGAGRGKCYGPQCLCR

SEQ ID NO: 506 - protein, 38 aa, Artificial Sequence
  Description of Artificial Sequence: Synthetic polypeptide
GSSCSPCFTTDHQSARACDDCCGGAGRGKCYGPQCLCR

SEQ ID NO: 507 - protein, 38 aa, Artificial Sequence
  Description of Artificial Sequence: Synthetic polypeptide
GSSCSPCFTTDHQSARRCDDCCGGAGRGKCYGPQCLCR

SEQ ID NO: 508 - protein, 38 aa, Artificial Sequence
  Description of Artificial Sequence: Synthetic polypeptide
GSSCSPCFTTDHQSARKCDDCCGGRGRGKCYGPQCLCR

SEQ ID NO: 509 - protein, 38 aa, Artificial Sequence
  Description of Artificial Sequence: Synthetic polypeptide
GSSCSPCFTTDHQSARACDDCCGGRGRGKCYGPQCLCR

SEQ ID NO: 510 - protein, 38 aa, Artificial Sequence
  Description of Artificial Sequence: Synthetic polypeptide
GSSCSPCFTTDHQSARRCDDCCGGRGRGKCYGPQCLCR

SEQ ID NO: 511 - protein, 38 aa, Artificial Sequence
  Description of Artificial Sequence: Synthetic polypeptide
GSSCSPCFTTDHQSARKCDDCCGGKGRGACYGPQCLCR

SEQ ID NO: 512 - protein, 38 aa, Artificial Sequence
  Description of Artificial Sequence: Synthetic polypeptide
GSSCSPCFTTDHQSARACDDCCGGKGRGACYGPQCLCR

SEQ ID NO: 513 - protein, 38 aa, Artificial Sequence
  Description of Artificial Sequence: Synthetic polypeptide
GSSCSPCFTTDHQSARRCDDCCGGKGRGACYGPQCLCR

SEQ ID NO: 514 - protein, 38 aa, Artificial Sequence
  Description of Artificial Sequence: Synthetic polypeptide
GSSCSPCFTTDHQSARKCDDCCGGAGRGACYGPQCLCR

SEQ ID NO: 515 - protein, 38 aa, Artificial Sequence
  Description of Artificial Sequence: Synthetic polypeptide
GSSCSPCFTTDHQSARACDDCCGGAGRGACYGPQCLCR

SEQ ID NO: 516 - protein, 38 aa, Artificial Sequence
  Description of Artificial Sequence: Synthetic polypeptide
GSSCSPCFTTDHQSARRCDDCCGGAGRGACYGPQCLCR

SEQ ID NO: 517 - protein, 38 aa, Artificial Sequence
  Description of Artificial Sequence: Synthetic polypeptide
GSSCSPCFTTDHQSARKCDDCCGGRGRGACYGPQCLCR

SEQ ID NO: 518 - protein, 38 aa, Artificial Sequence
  Description of Artificial Sequence: Synthetic polypeptide
GSSCSPCFTTDHQSARACDDCCGGRGRGACYGPQCLCR

SEQ ID NO: 519 - protein, 38 aa, Artificial Sequence
  Description of Artificial Sequence: Synthetic polypeptide
GSSCSPCFTTDHQSARRCDDCCGGRGRGACYGPQCLCR

SEQ ID NO: 520 - protein, 38 aa, Artificial Sequence
  Description of Artificial Sequence: Synthetic polypeptide
GSSCSPCFTTDHQSARKCDDCCGGKGRGRCYGPQCLCR

SEQ ID NO: 521 - protein, 38 aa, Artificial Sequence
  Description of Artificial Sequence: Synthetic polypeptide
GSSCSPCFTTDHQSARACDDCCGGKGRGRCYGPQCLCR

SEQ ID NO: 522 - protein, 38 aa, Artificial Sequence
  Description of Artificial Sequence: Synthetic polypeptide
GSSCSPCFTTDHQSARRCDDCCGGKGRGRCYGPQCLCR

SEQ ID NO: 523 - protein, 38 aa, Artificial Sequence
  Description of Artificial Sequence: Synthetic polypeptide
GSSCSPCFTTDHQSARKCDDCCGGAGRGRCYGPQCLCR

SEQ ID NO: 524 - protein, 38 aa, Artificial Sequence
  Description of Artificial Sequence: Synthetic polypeptide
GSSCSPCFTTDHQSARACDDCCGGAGRGRCYGPQCLCR

SEQ ID NO: 525 - protein, 38 aa, Artificial Sequence
  Description of Artificial Sequence: Synthetic polypeptide
GSSCSPCFTTDHQSARRCDDCCGGAGRGRCYGPQCLCR

SEQ ID NO: 526 - protein, 38 aa, Artificial Sequence
  Description of Artificial Sequence: Synthetic polypeptide
GSSCSPCFTTDHQSARKCDDCCGGRGRGRCYGPQCLCR

SEQ ID NO: 527 - protein, 38 aa, Artificial Sequence
  Description of Artificial Sequence: Synthetic polypeptide
GSSCSPCFTTDHQSARACDDCCGGRGRGRCYGPQCLCR

SEQ ID NO: 528 - protein, 38 aa, Artificial Sequence
  Description of Artificial Sequence: Synthetic polypeptide
GSSCSPCFTTDHQSARRCDDCCGGRGRGRCYGPQCLCR

SEQ ID NO: 529 - protein, 38 aa, Artificial Sequence
  Description of Artificial Sequence: Synthetic polypeptide
GSKCSPCFTTDHQSARRCDDCCGGRGRGRCYGPQCLCR

SEQ ID NO: 530 - protein, 38 aa, Artificial Sequence
  Description of Artificial Sequence: Synthetic polypeptide
  MOD_RES (17)..(17): Citrulline
  MOD_RES (25)..(25): Citrulline
GSSCSPCFTTDHQSARXCDDCCGGXGRGKCYGPQCLCR

SEQ ID NO: 531 - protein, 38 aa, Artificial Sequence
  Description of Artificial Sequence: Synthetic polypeptide
  MOD_RES (17)..(17): Citrulline
  MOD_RES (25)..(25): Citrulline
  MOD_RES (29)..(29): Citrulline
GSSCSPCFTTDHQSARXCDDCCGGXGRGXCYGPQCLCR

SEQ ID NO: 532 - protein, 38 aa, Artificial Sequence
  Description of Artificial Sequence: Synthetic polypeptide
  MOD_RES (17)..(17): Citrulline
  MOD_RES (25)..(25): Citrulline
  MOD_RES (29)..(29): Citrulline
GSKCSPCFTTDHQSARXCDDCCGGXGRGXCYGPQCLCR

SEQ ID NO: 533 - protein, 38 aa, Artificial Sequence
  Description of Artificial Sequence: Synthetic polypeptide
GSMCMPCFTTDPNMARKCRDCCGGNGKCFGPQCLCNRG

SEQ ID NO: 534 - protein, 38 aa, Artificial Sequence
  Description of Artificial Sequence: Synthetic polypeptide
GSMCMPCFTTDHNMAKKCRDCCGGNGKCFGYQCLCNRG

SEQ ID NO: 535 - protein, 38 aa, Artificial Sequence
  Description of Artificial Sequence: Synthetic polypeptide
GSMCMPCFTTDHQTARRCRDCCGGRGRKCFGQCLCGYD

SEQ ID NO: 536 - protein, 38 aa, Artificial Sequence
  Description of Artificial Sequence: Synthetic polypeptide
GSACGPCFTTDPQMAEKCSDCCGGIGTCYGPQCLCNRL

SEQ ID NO: 537 - protein, 36 aa, Artificial Sequence
  Description of Artificial Sequence: Synthetic polypeptide
GSMCMPCFTTRPNMAQQCRDCCRGRGKCFGPQCLCG

SEQ ID NO: 538 - protein, 38 aa, Artificial Sequence
  Description of Artificial Sequence: Synthetic polypeptide
GSMCMPCFTTRPNMAQQCRDCCRGRGKCFGPQCLCGYD

SEQ ID NO: 539 - protein, 36 aa, Artificial Sequence
  Description of Artificial Sequence: Synthetic polypeptide
GSMCMPCFTTNLNMEQECRDCCGGTGRCFGPQCLCG

SEQ ID NO: 540 - protein, 38 aa, Artificial Sequence
  Description of Artificial Sequence: Synthetic polypeptide
GSGCMPCFTTDRYMARKCKECCRGYGNCFGPQCLCNRG

SEQ ID NO: 541 - protein, 38 aa, Artificial Sequence
  Description of Artificial Sequence: Synthetic polypeptide
GSGCGPCFTTDANMARKCRECCGGNGKCFGPQCLCNRE

SEQ ID NO: 542 - protein, 38 aa, Artificial Sequence
  Description of Artificial Sequence: Synthetic polypeptide
GSGCGPCFTTDANMARKCRECCGGIGKCFGPQCLCNRI

SEQ ID NO: 543 - protein, 36 aa, Artificial Sequence
  Description of Artificial Sequence: Synthetic polypeptide
GSMCMPCFTTRPDMAQQCRACCKGRGKCFGPQCLCG

SEQ ID NO: 544 - protein, 36 aa, Artificial Sequence
  Description of Artificial Sequence: Synthetic polypeptide
GSMCIPCFTTNPNMAAKCNACCGSRRGSCRGPQCIC

SEQ ID NO: 545 - protein, 37 aa, Artificial Sequence
  Description of Artificial Sequence: Synthetic polypeptide
GSMCMPCFTTRPDMAQQCRDCCGGNGKCFGYQCLCNR

SEQ ID NO: 546 - protein, 36 aa, Artificial Sequence
  Description of Artificial Sequence: Synthetic polypeptide
GSCGPCFTTDPYTESKCATCCGGRGKCVGPQCLCNR

SEQ ID NO: 547 - protein, 37 aa, Artificial Sequence
  Description of Artificial Sequence: Synthetic polypeptide
GSRCGPCFTTDPQTQAKCSECCGRKGGVCKGPQCICG

SEQ ID NO: 548 - protein, 37 aa, Artificial Sequence
  Description of Artificial Sequence: Synthetic polypeptide
GSCGPCFTKDPETEKKCATCCGGIGRCFGPQCLCNRG

SEQ ID NO: 549 - protein, 38 aa, Artificial Sequence
  Description of Artificial Sequence: Synthetic polypeptide
GSMCMPCFTTDHQMARRCDDCCGGRGRGKCWGPQCLCR

SEQ ID NO: 550 - protein, 39 aa, Artificial Sequence
  Description of Artificial Sequence: Synthetic polypeptide
GSAMCMPCFTTDHNMAKKCRDCCGGNGKCFGPQCLCNRG

SEQ ID NO: 551 - protein, 37 aa, Artificial Sequence
  Description of Artificial Sequence: Synthetic polypeptide
GSCGPCFTTDWESEKKCAECCGGIGRCFGPQCLCNRK

SEQ ID NO: 552 - protein, 36 aa, Artificial Sequence
  Description of Artificial Sequence: Synthetic polypeptide
GSCGPCFTTDHQTEQKCAECCGGIGKCYGPQCLCRG

SEQ ID NO: 553 - protein, 36 aa, Artificial Sequence
  Description of Artificial Sequence: Synthetic polypeptide
GSCGPCFTTDRQMEQKCAECCGGIGKCYGPQCLCRG

SEQ ID NO: 554 - protein, 34 aa, Artificial Sequence
  Description of Artificial Sequence: Synthetic polypeptide
GSCGPCFTTDHQTEQKCAECCGGIGKCYGPQCLC

SEQ ID NO: 555 - protein, 36 aa, Artificial Sequence
  Description of Artificial Sequence: Synthetic polypeptide
GSCMPCFTTDHQMARKCDDCCGGRGKCYGPQCLCRG

SEQ ID NO: 556 - protein, 39 aa, Artificial Sequence
  Description of Artificial Sequence: Synthetic polypeptide
GSRCGPCFTTDPQTQAKCSECCGRKGGVCKGPQCICGIQ

SEQ ID NO: 557 - protein, 37 aa, Artificial Sequence
  Description of Artificial Sequence: Synthetic polypeptide
GSRCPPCFTTNPNMEADCRKCCGGRGYCASYQCICPG

SEQ ID NO: 558 - protein, 37 aa, Artificial Sequence
  Description of Artificial Sequence: Synthetic polypeptide
GSCGPCFTTDHNMARKCDECCGGKGRGKCFGPQCLCR

SEQ ID NO: 559 - protein, 38 aa, Artificial Sequence
  Description of Artificial Sequence: Synthetic polypeptide
GSVCMPCFTTDQQMARKCSDCCGGKGRGKCYGPQCLCR

SEQ ID NO: 560 - protein, 38 aa, Artificial Sequence
  Description of Artificial Sequence: Synthetic polypeptide
GSMCGPCFTTDANMARKCRECCGGIGKCFGPQCLCNRI

SEQ ID NO: 561 - protein, 38 aa, Artificial Sequence
  Description of Artificial Sequence: Synthetic polypeptide
GSMCGPCFTTDANMAAACRECCGGIGKCFGPQCLCNRI

SEQ ID NO: 562 - protein, 38 aa, Artificial Sequence
  Description of Artificial Sequence: Synthetic polypeptide
GSMCGPCFTTDANMARKCAECCGGIGKCFGPQCLCNRI

SEQ ID NO: 563 - protein, 38 aa, Artificial Sequence
  Description of Artificial Sequence: Synthetic polypeptide
GSMCGPCFTTDANMARKCRECCGGIGACFGPQCLCNRI

SEQ ID NO: 564 - protein, 38 aa, Artificial Sequence
  Description of Artificial Sequence: Synthetic polypeptide
GSMCGPCFTTDANMARKCRECCGGIGKCFGPQCLCNAI

SEQ ID NO: 565 - protein, 37 aa, Artificial Sequence
  Description of Artificial Sequence: Synthetic polypeptide
GSCMPCFTTRPNMAQQCRDCCRGRGKCFGPQCLCGYD

SEQ ID NO: 566 - protein, 38 aa, Artificial Sequence
  Description of Artificial Sequence: Synthetic polypeptide
GSMCMPCFTTNLNMEQECRDCCGGTGRCFGPQCLCGYD

SEQ ID NO: 567 - protein, 37 aa, Artificial Sequence; identical to SEQ ID NO: 565
  Description of Artificial Sequence: Synthetic polypeptide

SEQ ID NO: 568 - protein, 36 aa, Artificial Sequence
  Description of Artificial Sequence: Synthetic polypeptide
MCMPCFTTDHQMARKCDDCCGGKGRGKCYGPQCLCR

SEQ ID NO: 569 - protein, 36 aa, Artificial Sequence
  Description of Artificial Sequence: Synthetic polypeptide
MCMPCFTTDHQMARRCDDCCGGRGRGKCYGPQCLCR

SEQ ID NO: 570 - protein, 36 aa, Artificial Sequence
  Description of Artificial Sequence: Synthetic polypeptide
MCMPCFTTDHQMARRCDDCCGGRGRGRCYGPQCLCR

SEQ ID NO: 571 - protein, 36 aa, Artificial Sequence
  Description of Artificial Sequence: Synthetic polypeptide
MCMPCFTTDHQMARKCDDCCGGRGRGRCYGPQCLCR

SEQ ID NO: 572 - protein, 36 aa, Artificial Sequence
  Description of Artificial Sequence: Synthetic polypeptide
MCMPCFTTDHQMARRCDDCCGGKGRGRCYGPQCLCR

SEQ ID NO: 573 - protein, 36 aa, Artificial Sequence
  Description of Artificial Sequence: Synthetic polypeptide
MCMPCFTTHHRMAENCDICCGGDGRGKCYGPQCLCR

SEQ ID NO: 574 - protein, 36 aa, Artificial Sequence
  Description of Artificial Sequence: Synthetic polypeptide
MCMPCFTTDTQMQERCDRCCGGGGRGKCWGPQCLCI

SEQ ID NO: 575 - protein, 36 aa, Artificial Sequence
  Description of Artificial Sequence: Synthetic polypeptide
MCMPCFTTDTQMQERCDRCCGGGGRGRCWGPQCLCI

SEQ ID NO: 576 - protein, 36 aa, Artificial Sequence
  Description of Artificial Sequence: Synthetic polypeptide
MCMPCFTTEQRMAIICDDCCGGFGRGKCYGPQCLCR

SEQ ID NO: 577 - protein, 36 aa, Artificial Sequence
  Description of Artificial Sequence: Synthetic polypeptide
MCMPCFTTEQRMAIICDDCCGGFGRGRCYGPQCLCR

SEQ ID NO: 578 - protein, 36 aa, Artificial Sequence
  Description of Artificial Sequence: Synthetic polypeptide
ICIPCFTTDHQIARRCDDCCGGRGRGKCYGPQCICR

SEQ ID NO: 579 - protein, 36 aa, Artificial Sequence
  Description of Artificial Sequence: Synthetic polypeptide
ICIPCFTTDHQIARRCDDCCGGRGRGRCYGPQCICR

SEQ ID NO: 580 - protein, 36 aa, Artificial Sequence
  Description of Artificial Sequence: Synthetic polypeptide
MCMPCFTTDHRMAENCDICCGGDGRGKCYGPQCLCR

SEQ ID NO: 581 - protein, 36 aa, Artificial Sequence
  Description of Artificial Sequence: Synthetic polypeptide
MCMPCFTTDHRMAENCDICCGGDGRGRCYGPQCLCR

SEQ ID NO: 582 - protein, 36 aa, Artificial Sequence
  Description of Artificial Sequence: Synthetic polypeptide
MCMPCFTTEQRMAIICDDCCGGFGRGKCYGPQCLCI

SEQ ID NO: 583 - protein, 36 aa, Artificial Sequence
  Description of Artificial Sequence: Synthetic polypeptide
MCMPCFTTEQRMAIICDDCCGGFGRGRCYGPQCLCI

SEQ ID NO: 584 - protein, 36 aa, Artificial Sequence
  Description of Artificial Sequence: Synthetic polypeptide
ICIPCFTTDHQIARRCDDCCGGRGRGKCYGPQCICI

SEQ ID NO: 585 - protein, 36 aa, Artificial Sequence
  Description of Artificial Sequence: Synthetic polypeptide
ICIPCFTTDHQIARRCDDCCGGRGRGRCYGPQCICI

SEQ ID NO: 586 - protein, 36 aa, Artificial Sequence
  Description of Artificial Sequence: Synthetic polypeptide
MCMPCFTTDHRMAENCDICCGGDGRGKCYGPQCLCI

SEQ ID NO: 587 - protein, 36 aa, Artificial Sequence
  Description of Artificial Sequence: Synthetic polypeptide
MCMPCFTTDHRMAENCDICCGGDGRGRCYGPQCLCI

SEQ ID NO: 588 - protein, 36 aa, Artificial Sequence
  Description of Artificial Sequence: Synthetic polypeptide
MCMPCFTTDTQMQEKCDRCCGGGGRGRCWGPQCLCI

SEQ ID NO: 589 - protein, 36 aa, Artificial Sequence
  Description of Artificial Sequence: Synthetic polypeptide
MCMPCFTTEQRMAIKCDDCCGGFGRGRCYGPQCLCR

SEQ ID NO: 590 - protein, 36 aa, Artificial Sequence
  Description of Artificial Sequence: Synthetic polypeptide
ICIPCFTTDHQIARKCDDCCGGRGRGRCYGPQCICR

SEQ ID NO: 591 - protein, 36 aa, Artificial Sequence
  Description of Artificial Sequence: Synthetic polypeptide
MCMPCFTTDHRMAEKCDICCGGDGRGRCYGPQCLCR

SEQ ID NO: 592 - protein, 36 aa, Artificial Sequence
  Description of Artificial Sequence: Synthetic polypeptide
MCMPCFTTDTQMQERCDRCCGGKGRGRCWGPQCLCI

SEQ ID NO: 593 - protein, 36 aa, Artificial Sequence
  Description of Artificial Sequence: Synthetic polypeptide
MCMPCFTTEQRMAIICDDCCGGKGRGRCYGPQCLCR

SEQ ID NO: 594 - protein, 36 aa, Artificial Sequence
  Description of Artificial Sequence: Synthetic polypeptide
ICIPCFTTDHQIARRCDDCCGGKGRGRCYGPQCICR

SEQ ID NO: 595 - protein, 36 aa, Artificial Sequence
  Description of Artificial Sequence: Synthetic polypeptide
MCMPCFTTDHRMAENCDICCGGKGRGRCYGPQCLCR

SEQ ID NO: 596 - protein, 36 aa, Artificial Sequence
  Description of Artificial Sequence: Synthetic polypeptide
MCMPCFTTHHRMAENCDICCGGDGRGRCYGPQCLCR

SEQ ID NO: 597 - protein, 35 aa, Artificial Sequence
  Description of Artificial Sequence: Synthetic polypeptide
MCMPCFTTDTQMQERCDRCCGGGGRGRCWGPQCLC

SEQ ID NO: 598 - protein, 35 aa, Artificial Sequence
  Description of Artificial Sequence: Synthetic polypeptide
MCMPCFTTEQRMAIICDDCCGGFGRGRCYGPQCLC

SEQ ID NO: 599 - protein, 35 aa, Artificial Sequence
  Description of Artificial Sequence: Synthetic polypeptide
ICIPCFTTDHQIARRCDDCCGGRGRGRCYGPQCIC

SEQ ID NO: 600 - protein, 35 aa, Artificial Sequence
  Description of Artificial Sequence: Synthetic polypeptide
MCMPCFTTDHRMAENCDICCGGDGRGRCYGPQCLC

SEQ ID NO: 601 - protein, 36 aa, Artificial Sequence
  Description of Artificial Sequence: Synthetic polypeptide
MCMPCFTTDHQMARRCDDCCGGRGRGRCYGPQCLCI

SEQ ID NO: 602 - protein, 36 aa, Artificial Sequence
  Description of Artificial Sequence: Synthetic polypeptide
ACAPCFTTDHQAARRCDDCCGGRGRGKCYGPQCLCR

SEQ ID NO: 603 - protein, 36 aa, Artificial Sequence
  Description of Artificial Sequence: Synthetic polypeptide
ACAPCFTTDHQAARKCDDCCGGKGRGKCYGPQCLCR

SEQ ID NO: 604 - protein, 36 aa, Artificial Sequence
  Description of Artificial Sequence: Synthetic polypeptide
MCMPCFTTHHRMAENCDICCGGDGRGKCYGPQCLCI

SEQ ID NO: 605 - protein, 35 aa, Artificial Sequence
  Description of Artificial Sequence: Synthetic polypeptide
MCMPCFTTHHRMAENCDICCGGDGRGKCYGPQCLC

SEQ ID NO: 606 - protein, 35 aa, Artificial Sequence
  Description of Artificial Sequence: Synthetic polypeptide
MCMPCFTTDHQMARRCDDCCGGRGRGRCYGPQCLC

SEQ ID NO: 607 - protein, 36 aa, Artificial Sequence
  Description of Artificial Sequence: Synthetic polypeptide
MCMPCFTTHHQMAENCDICCGGDGRGKCYGPQCLCR

SEQ ID NO: 608 - protein, 36 aa, Artificial Sequence
  Description of Artificial Sequence: Synthetic polypeptide
MCMPCFTTHHRMARNCDICCGGDGRGKCYGPQCLCR

SEQ ID NO: 609 - protein, 36 aa, Artificial Sequence
  Description of Artificial Sequence: Synthetic polypeptide
MCMPCFTTHHRMAERCDICCGGDGRGKCYGPQCLCR

SEQ ID NO: 610 - protein, 36 aa, Artificial Sequence
  Description of Artificial Sequence: Synthetic polypeptide
MCMPCFTTHHRMAENCDDCCGGDGRGKCYGPQCLCR

SEQ ID NO: 611 - protein, 36 aa, Artificial Sequence
  Description of Artificial Sequence: Synthetic polypeptide
RCMPCFTTDHQMARRCDDCCGGRGRGKCYGPQCLCR

SEQ ID NO: 612 - protein, 36 aa, Artificial Sequence
  Description of Artificial Sequence: Synthetic polypeptide
ICIPCFTTDHQIARRCDDCCGGRGRGKCYGPQCLCR

SEQ ID NO: 613 - protein, 36 aa, Artificial Sequence
  Description of Artificial Sequence: Synthetic polypeptide
MCLPCFTTDHQLARRCDDCCGGRGRGKCYGPQCLCR

SEQ ID NO: 614 - protein, 36 aa, Artificial Sequence
  Description of Artificial Sequence: Synthetic polypeptide
MCMPCFTTEHQMARRCEECCGGRGRGKCYGPQCLCR

SEQ ID NO: 615 - protein, 36 aa, Artificial Sequence
  Description of Artificial Sequence: Synthetic polypeptide
MCIPCFTTDHQMARRCEECCGGRGRGKCYGPQCLCR

SEQ ID NO: 616 - protein, 36 aa, Artificial Sequence
  Description of Artificial Sequence: Synthetic polypeptide
ICIPCFTTDHQMARRCDDCCGGRGDGKCYGPQCLCR

SEQ ID NO: 617 - protein, 36 aa, Artificial Sequence
  Description of Artificial Sequence: Synthetic polypeptide
RCMPCFTTDHFMARFCDFCCGGRGRGKCYGPQCLCR

SEQ ID NO: 618 - protein, 36 aa, Artificial Sequence
  Description of Artificial Sequence: Synthetic polypeptide
RCMPCFTTDHYMARYCDYCCGGRGRGKCYGPQCLCR

SEQ ID NO: 619 - protein, 36 aa, Artificial Sequence
  Description of Artificial Sequence: Synthetic polypeptide
RCMPCFTTDHRMARRCDRCCGGRGRGKCYGPQCLCR

SEQ ID NO: 620 - protein, 36 aa, Artificial Sequence
  Description of Artificial Sequence: Synthetic polypeptide
RCMPCFTTDHEMARECDECCGGRGRGKCYGPQCLCR

SEQ ID NO: 621 - protein, 36 aa, Artificial Sequence
  Description of Artificial Sequence: Synthetic polypeptide
RCMPCFTTDHHMARHCDHCCGGRGRGKCYGPQCLCR

SEQ ID NO: 622 - protein, 36 aa, Artificial Sequence
  Description of Artificial Sequence: Synthetic polypeptide
LCLPCFTTHHRLADQCDICCGGDGRGKCYGPQCLCR

SEQ ID NO: 623 - protein, 36 aa, Artificial Sequence
  Description of Artificial Sequence: Synthetic polypeptide
ICIPCFTTEHQIARRCEECCGGRGRGKCYGPQCLCR

SEQ ID NO: 624 - protein, 36 aa, Artificial Sequence
  Description of Artificial Sequence: Synthetic polypeptide
MCMPCFTTIYRMAHECDECCGGRGRGKCYGPQCLCR

SEQ ID NO: 625 - protein, 36 aa, Artificial Sequence
  Description of Artificial Sequence: Synthetic polypeptide
MCMPCFTTGYRMAEYCDICCGGRGRGKCYGPQCLCR

SEQ ID NO: 626 - protein, 36 aa, Artificial Sequence
  Description of Artificial Sequence: Synthetic polypeptide
MCMPCFTTHRRMANTCDACCGGRSRGKCYGPQCLCR

SEQ ID NO: 627 - protein, 36 aa, Artificial Sequence
  Description of Artificial Sequence: Synthetic polypeptide
HCMPCFTTDHQMIRRCDDCCGGGSYGKCDGPQCLCF

SEQ ID NO: 628 - protein, 36 aa, Artificial Sequence
  Description of Artificial Sequence: Synthetic polypeptide
DCMPCFTTDHRMADHCDICCGGDDRGKCYGPQCLCR

SEQ ID NO: 629 - protein, 36 aa, Artificial Sequence
  Description of Artificial Sequence: Synthetic polypeptide
MCMPCFTTDHEMERRCDDCCGIGGGGKCHGPQCLCG

SEQ ID NO: 630 - protein, 36 aa, Artificial Sequence
  Description of Artificial Sequence: Synthetic polypeptide
MCMPCFTTSEQMFRRCDDCCGGWGDGKCNGPHCLCR

SEQ ID NO: 631 - protein, 34 aa, Artificial Sequence
  Description of Artificial Sequence: Synthetic polypeptide
CGPCFTTDHQMEQKCAECCGGIGKCYGPQCLCNR

SEQ ID NO: 632 - protein, 38 aa, Artificial Sequence
  Description of Artificial Sequence: Synthetic polypeptide
RCGPCFTTDPQTQAKCSECCGRKGGVCKGPQCICGIQY

SEQ ID NO: 633 - protein, 35 aa, Artificial Sequence
  Description of Artificial Sequence: Synthetic polypeptide
MCMPCFTTDPNMAKKCRDCCGGNGKCFGPQCLCNR

SEQ ID NO: 634 - protein, 34 aa, Artificial Sequence
  Description of Artificial Sequence: Synthetic polypeptide
MCMPCFTTDHNMAKKCNDCCGGYGKCFGPQCLCR

SEQ ID NO: 635 - protein, 36 aa, Artificial Sequence
  Description of Artificial Sequence: Synthetic polypeptide
RCPPCFTTNPNMEADCRKCCGGRGYCASYQCICPGG

SEQ ID NO: 636 - protein, 35 aa, Artificial Sequence
  Description of Artificial Sequence: Synthetic polypeptide
MCMPCFTTDPNMANKCRDCCGGGKKCFGPQCLCNR

SEQ ID NO: 637 - protein, 62 aa, Artificial Sequence
  Description of Artificial Sequence: Synthetic polypeptide
MKFLYGVILIALFLTVMTATLSEARCGPCFTTDPQTQAKCSECCGRKGGVCKGPQCICGIQY

SEQ ID NO: 638 - protein, 36 aa, Artificial Sequence
  Description of Artificial Sequence: Synthetic polypeptide
MCMPCFTTRPDMAQQCRACCKGRGKCFGPQCLCGYD

SEQ ID NO: 639 - protein, 60 aa, Artificial Sequence
  Description of Artificial Sequence: Synthetic polypeptide
MKFLYGIVFIALFLTVMTATLSDAMCMPCFTTDHNMAKKCRDCCGGNGKCFGPQCLCNRG

SEQ ID NO: 640 - protein, 35 aa, Artificial Sequence
  Description of Artificial Sequence: Synthetic polypeptide
MCMPCFTTDHNMAKKCRDCCGGNGKCFGPQCLCNR

SEQ ID NO: 641 - protein, 60 aa, Artificial Sequence
  Description of Artificial Sequence: Synthetic polypeptide
MKFLYGIVFITLFLTVMIATHTEAMCMPCFTTRPNMAQQCRDCCRGRGKCFGPQCLCGYD

SEQ ID NO: 642 - protein, 60 aa, Artificial Sequence
  Description of Artificial Sequence: Synthetic polypeptide
MKFLYGIVFIALFLTVMIATHTEAMCMPCFTTRPNMAQQCRDCCRGRGKCFGPQCLCGYD

SEQ ID NO: 643 - protein, 35 aa, Artificial Sequence
  Description of Artificial Sequence: Synthetic polypeptide
RCKPCFTTDPQMSKKCADCCGGKGKGKCYGPQCLC

SEQ ID NO: 644 - protein, 61 aa, Artificial Sequence
  Description of Artificial Sequence: Synthetic polypeptide
MKFLYGIVFITLFLTVMIATHTEAAMCMPCFTTNLNMEQECRDCCGGTGRCFGPQCLCGYD

SEQ ID NO: 645 - protein, 38 aa, Artificial Sequence
  Description of Artificial Sequence: Synthetic polypeptide
RCSPCFTTDQQMTKKCYDCCGGKGKGKCYGPQCICAPY

SEQ ID NO: 646 - protein, 35 aa, Artificial Sequence
  Description of Artificial Sequence: Synthetic polypeptide
CGPCFTTDPYTESKCATCCGGRGKCVGPQCLCNRI

SEQ ID NO: 647 - protein, 39 aa, Artificial Sequence
  Description of Artificial Sequence: Synthetic polypeptide
TEAMCMPCFTTDHNMAKKCRDCCGGNGKCFGYQCLCNRG

SEQ ID NO: 648 - protein, 59 aa, Artificial Sequence
  Description of Artificial Sequence: Synthetic polypeptide
MKFLYGIVFIALFLTVMFATQTDGCGPCFTTDANMARKCRECCGGIGKCFGPQCLCNRI

SEQ ID NO: 649 - protein, 59 aa, Artificial Sequence
  Description of Artificial Sequence: Synthetic polypeptide
MKFLYGIVFIALFLTVMFATQTDGCGPCFTTDANMARKCRECCGGNGKCFGPQCLCNRE

SEQ ID NO: 650 - protein, 60 aa, Artificial Sequence
  Description of Artificial Sequence: Synthetic polypeptide
MKFLYGTILIAFFLTVMIATHSEARCPPCFTTNPNMEADCRKCCGGRGYCASYQCICPGG

SEQ ID NO: 651 - protein, 39 aa, Artificial Sequence
  Description of Artificial Sequence: Synthetic polypeptide
TEAMCMPCFTTRPDMAQQCRDCCGGNGKCFGYQCLCNRG

SEQ ID NO: 652 - protein, 60 aa, Artificial Sequence
  Description of Artificial Sequence: Synthetic polypeptide
MKFLYGIVFIALFLTVMIATLTEAMCMPCFTTRPDMAQQCRDCCGGNGKCFGYQCLCNRG

SEQ ID NO: 653 - protein, 60 aa, Artificial Sequence
  Description of Artificial Sequence: Synthetic polypeptide
MKFLYGIVFIALFLTVMIATHTEAMCMPCFTTRPDMAQQCRDCCGGNGKCFGYQCLCNRG

SEQ ID NO: 654 - protein, 61 aa, Artificial Sequence
  Description of Artificial Sequence: Synthetic polypeptide
MKFLYGIILIALFLTVMIATHSEARCPNCFTTNPNAEADCKKCCGNRWGKCAGYQCVCPMK

SEQ ID NO: 655 - protein, 67 aa, Artificial Sequence
  Description of Artificial Sequence: Synthetic polypeptide
MKFLYGIVFIALFLTGMIATHTEAMCMPCFTTRPDMAQQCRDCCGGNGKCFGYQCLCNRGRIVIMYT

SEQ ID NO: 656 - protein, 35 aa, Artificial Sequence
  Description of Artificial Sequence: Synthetic polypeptide
MCMPCFTTRPGMAQQCRDCCGGNGKCFGYQCLCNR

SEQ ID NO: 657 - protein, 35 aa, Artificial Sequence
  Description of Artificial Sequence: Synthetic polypeptide
MCIPCFTTNPNMAAKCNACCGSRRGSCRGPQCICR

SEQ ID NO: 658 - protein, 35 aa, Artificial Sequence
  Description of Artificial Sequence: Synthetic polypeptide
MCIPCFTTNPNMAAKCNACCGSRRGSCRGPQCICN

SEQ ID NO: 659 - protein, 34 aa, Artificial Sequence
  Description of Artificial Sequence: Synthetic polypeptide
MCIPCFTTNPNMAAKCNACCGGNGSCRGPQCICN

SEQ ID NO: 660 - protein, 36 aa, Artificial Sequence
  Description of Artificial Sequence: Synthetic polypeptide
MCIPCFTTNPNMAAKCNACCGSRGRGSCRGPQCICN

SEQ ID NO: 661 - protein, 36 aa, Artificial Sequence
  Description of Artificial Sequence: Synthetic polypeptide
MCIPCFTTNPNMAAKCNACCGSRGRGKCRGPQCICN

SEQ ID NO: 662 - protein, 35 aa, Artificial Sequence
  Description of Artificial Sequence: Synthetic polypeptide
MCIPCFTTDHQMAAKCNACCGSRRGSCRGPQCICN

SEQ ID NO: 663 - protein, 35 aa, Artificial Sequence
  Description of Artificial Sequence: Synthetic polypeptide
MCIPCFTTNHQMAAKCNACCGSRRGSCRGPQCICN

SEQ ID NO: 664 - protein, 36 aa, Artificial Sequence
  Description of Artificial Sequence: Synthetic polypeptide
MCIPCFTTNPNMARKCNACCGSRGRGSCRGPQCICN

SEQ ID NO: 665 - protein, 36 aa, Artificial Sequence
  Description of Artificial Sequence: Synthetic polypeptide
MCIPCFTTNPNMAAKCNACCGGKGRGSCRGPQCICN

SEQ ID NO: 666 - protein, 35 aa, Artificial Sequence
  Description of Artificial Sequence: Synthetic polypeptide
MCIPCFTTNPNMAAKCNACCGSRRGSCFGPQCICN

SEQ ID NO: 667 - protein, 36 aa, Artificial Sequence
  Description of Artificial Sequence: Synthetic polypeptide
MCIPCFTTNPNMAAKCNACCGSRGRGKCFGPQCICN

SEQ ID NO: 668 - protein, 36 aa, Artificial Sequence
  Description of Artificial Sequence: Synthetic polypeptide
MCIPCFTTNPNMAAKCNACCGSRGRGSCFGPQCICN

SEQ ID NO: 669 - protein, 36 aa, Artificial Sequence
  Description of Artificial Sequence: Synthetic polypeptide
MCIPCFTTNPNMAAKCNACCGSRGRGSCYGPQCICN

SEQ ID NO: 670 - protein, 35 aa, Artificial Sequence
  Description of Artificial Sequence: Synthetic polypeptide
MCIPCFTTNPNMAAKCDACCGSRRGSCRGPQCICN

SEQ ID NO: 671 - protein, 35 aa, Artificial Sequence
  Description of Artificial Sequence: Synthetic polypeptide
MCIPCFTTNHQMAAKCDACCGSRRGSCRGPQCICN

SEQ ID NO: 672 - protein, 36 aa, Artificial Sequence
  Description of Artificial Sequence: Synthetic polypeptide
MCIPCFTTNHNMAAKCDACCGGRGRGSCRGPQCICN

SEQ ID NO: 673 - protein, 36 aa, Artificial Sequence
  Description of Artificial Sequence: Synthetic polypeptide
MCIPCFTTNPNMAAKCDACCGSRGRGSCRGPQCICN

SEQ ID NO: 674 - protein, 36 aa, Artificial Sequence
  Description of Artificial Sequence: Synthetic polypeptide
MCIPCFTTNPNMAAKCDACCGGKGRGSCRGPQCICN

SEQ ID NO: 675 - protein, 36 aa, Artificial Sequence
  Description of Artificial Sequence: Synthetic polypeptide
MCIPCFTTNHNMAAKCDACCGSRGRGSCRGPQCICN

SEQ ID NO: 676 - protein, 34 aa, Artificial Sequence
  Description of Artificial Sequence: Synthetic polypeptide
MCIPCFTTNPNMAAKCRDCCGGRGSCRGPQCICN

SEQ ID NO: 677 - protein, 36 aa, Artificial Sequence
  Description of Artificial Sequence: Synthetic polypeptide
MCMPCFTTNPNMAAKCDDCCGSRGRGSCRGPQCICN

SEQ ID NO: 678 - protein, 34 aa, Artificial Sequence
  Description of Artificial Sequence: Synthetic polypeptide
MCIPCFTTNPNMAARCNACCGSRRGSCRGPQCIC

SEQ ID NO: 679 - protein, 35 aa, Artificial Sequence
  Description of Artificial Sequence: Synthetic polypeptide
MCIPCFTTNPNMAAKCNACCGSRRGSCRGPQCICI

SEQ ID NO: 680 - protein, 36 aa, Artificial Sequence
  Description of Artificial Sequence: Synthetic polypeptide
MCMPCFTTDHQMARACDDCCGGKGRGKCYGPQCLCR

SEQ ID NO: 681 - protein, 36 aa, Artificial Sequence
  Description of Artificial Sequence: Synthetic polypeptide
MCMPCFTTDHQMARRCDDCCGGKGRGKCYGPQCLCR

SEQ ID NO: 682 - protein, 36 aa, Artificial Sequence
  Description of Artificial Sequence: Synthetic polypeptide
MCMPCFTTDHQMARKCDDCCGGAGRGKCYGPQCLCR

SEQ ID NO: 683 - protein, 36 aa, Artificial Sequence
  Description of Artificial Sequence: Synthetic polypeptide
MCMPCFTTDHQMARACDDCCGGAGRGKCYGPQCLCR

SEQ ID NO: 684 - protein, 36 aa, Artificial Sequence
  Description of Artificial Sequence: Synthetic polypeptide
MCMPCFTTDHQMARRCDDCCGGAGRGKCYGPQCLCR

SEQ ID NO: 685 - protein, 36 aa, Artificial Sequence
  Description of Artificial Sequence: Synthetic polypeptide
MCMPCFTTDHQMARKCDDCCGGRGRGKCYGPQCLCR

SEQ ID NO: 686 - protein, 36 aa, Artificial Sequence
  Description of Artificial Sequence: Synthetic polypeptide
MCMPCFTTDHQMARACDDCCGGRGRGKCYGPQCLCR

SEQ ID NO: 687 - protein, 36 aa, Artificial Sequence
  Description of Artificial Sequence: Synthetic polypeptide
MCMPCFTTDHQMARKCDDCCGGKGRGACYGPQCLCR

SEQ ID NO: 688 - protein, 36 aa, Artificial Sequence
  Description of Artificial Sequence: Synthetic polypeptide
MCMPCFTTDHQMARACDDCCGGKGRGACYGPQCLCR

SEQ ID NO: 689 - protein, 36 aa, Artificial Sequence
  Description of Artificial Sequence: Synthetic polypeptide
MCMPCFTTDHQMARRCDDCCGGKGRGACYGPQCLCR

SEQ ID NO: 690 - protein, 36 aa, Artificial Sequence
  Description of Artificial Sequence: Synthetic polypeptide
MCMPCFTTDHQMARKCDDCCGGAGRGACYGPQCLCR

SEQ ID NO: 691 - protein, 36 aa, Artificial Sequence
  Description of Artificial Sequence: Synthetic polypeptide
MCMPCFTTDHQMARACDDCCGGAGRGACYGPQCLCR

SEQ ID NO: 692 - protein, 36 aa, Artificial Sequence
  Description of Artificial Sequence: Synthetic polypeptide
MCMPCFTTDHQMARRCDDCCGGAGRGACYGPQCLCR

SEQ ID NO: 693 - protein, 36 aa, Artificial Sequence
  Description of Artificial Sequence: Synthetic polypeptide
MCMPCFTTDHQMARKCDDCCGGRGRGACYGPQCLCR

SEQ ID NO: 694 - protein, 36 aa, Artificial Sequence
  Description of Artificial Sequence: Synthetic polypeptide
MCMPCFTTDHQMARACDDCCGGRGRGACYGPQCLCR

SEQ ID NO: 695 - protein, 36 aa, Artificial Sequence
  Description of Artificial Sequence: Synthetic polypeptide
MCMPCFTTDHQMARRCDDCCGGRGRGACYGPQCLCR

SEQ ID NO: 696 - protein, 36 aa, Artificial Sequence
  Description of Artificial Sequence: Synthetic polypeptide
MCMPCFTTDHQMARKCDDCCGGKGRGRCYGPQCLCR

SEQ ID NO: 697 - protein, 36 aa, Artificial Sequence
  Description of Artificial Sequence: Synthetic polypeptide
MCMPCFTTDHQMARACDDCCGGKGRGRCYGPQCLCR

SEQ ID NO: 698 - protein, 36 aa, Artificial Sequence
  Description of Artificial Sequence: Synthetic polypeptide
MCMPCFTTDHQMARKCDDCCGGAGRGRCYGPQCLCR

SEQ ID NO: 699 - protein, 36 aa, Artificial Sequence
  Description of Artificial Sequence: Synthetic polypeptide
MCMPCFTTDHQMARACDDCCGGAGRGRCYGPQCLCR

SEQ ID NO: 700 - protein, 36 aa, Artificial Sequence
  Description of Artificial Sequence: Synthetic polypeptide
MCMPCFTTDHQMARRCDDCCGGAGRGRCYGPQCLCR

SEQ ID NO: 701 - protein, 36 aa, Artificial Sequence
  Description of Artificial Sequence: Synthetic polypeptide
MCMPCFTTDHQMARACDDCCGGRGRGRCYGPQCLCR

SEQ ID NO: 702 - protein, 36 aa, Artificial Sequence
  Description of Artificial Sequence: Synthetic polypeptide
KCMPCFTTDHQMARRCDDCCGGRGRGRCYGPQCLCR

SEQ ID NO: 703 - protein, 36 aa, Artificial Sequence
  Description of Artificial Sequence: Synthetic polypeptide
ACAPCFTTDHQAARRCDDCCGGRGRGRCYGPQCLCR

SEQ ID NO: 704 - protein, 36 aa, Artificial Sequence
  Description of Artificial Sequence: Synthetic polypeptide
KCAPCFTTDHQAARRCDDCCGGRGRGRCYGPQCLCR

SEQ ID NO: 705 - protein, 36 aa, Artificial Sequence
  Description of Artificial Sequence: Synthetic polypeptide
  MOD_RES (15)..(15): Citrulline
  MOD_RES (23)..(23): Citrulline
MCMPCFTTDHQMARXCDDCCGGXGRGKCYGPQCLCR

SEQ ID NO: 706 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
MCMPCFTTDHQMARXCDDCCGGXGRGXCYGPQCLCR

SEQ ID NO: 707 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
KCMPCFTTDHQMARXCDDCCGGXGRGXCYGPQCLCR

SEQ ID NO: 708 - protein, 36 aa, Artificial Sequence
  Description of Artificial Sequence: Synthetic polypeptide
  MOD_RES (15)..(15): Citrulline
  MOD_RES (23)..(23): Citrulline
ACAPCFTTDHQAARXCDDCCGGXGRGKCYGPQCLCR

SEQ ID NO: 709 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
ACAPCFTTDHQAARXCDDCCGGXGRGXCYGPQCLCR

SEQ ID NO: 710 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
KCAPCFTTDHQAARXCDDCCGGXGRGXCYGPQCLCR

SEQ ID NO: 711 - protein, 43 aa, Artificial Sequence
  Description of Artificial Sequence: Synthetic polypeptide
MCMPCFTTDHQMARKCDDCCGGKGRGKCYGPQCLCRGAGAAGG

SEQ ID NO: 712 - protein, 43 aa, Artificial Sequence
  Description of Artificial Sequence: Synthetic polypeptide
MCMPCFTTDHQMARACDDCCGGKGRGKCYGPQCLCRGAGAAGG

SEQ ID NO: 713 - protein, 43 aa, Artificial Sequence
  Description of Artificial Sequence: Synthetic polypeptide
MCMPCFTTDHQMARRCDDCCGGKGRGKCYGPQCLCRGAGAAGG

SEQ ID NO: 714 - protein, 43 aa, Artificial Sequence
  Description of Artificial Sequence: Synthetic polypeptide
MCMPCFTTDHQMARKCDDCCGGAGRGKCYGPQCLCRGAGAAGG

SEQ ID NO: 715 - protein, 43 aa, Artificial Sequence
  Description of Artificial Sequence: Synthetic polypeptide
MCMPCFTTDHQMARACDDCCGGAGRGKCYGPQCLCRGAGAAGG

SEQ ID NO: 716 - protein, 43 aa, Artificial Sequence
  Description of Artificial Sequence: Synthetic polypeptide
MCMPCFTTDHQMARRCDDCCGGAGRGKCYGPQCLCRGAGAAGG

SEQ ID NO: 717 - protein, 43 aa, Artificial Sequence
  Description of Artificial Sequence: Synthetic polypeptide
MCMPCFTTDHQMARKCDDCCGGRGRGKCYGPQCLCRGAGAAGG

SEQ ID NO: 718 - protein, 43 aa, Artificial Sequence
  Description of Artificial Sequence: Synthetic polypeptide
MCMPCFTTDHQMARACDDCCGGRGRGKCYGPQCLCRGAGAAGG

SEQ ID NO: 719 - protein, 43 aa, Artificial Sequence
  Description of Artificial Sequence: Synthetic polypeptide
MCMPCFTTDHQMARRCDDCCGGRGRGKCYGPQCLCRGAGAAGG

SEQ ID NO: 720 - protein, 43 aa, Artificial Sequence
  Description of Artificial Sequence: Synthetic polypeptide
MCMPCFTTDHQMARKCDDCCGGKGRGACYGPQCLCRGAGAAGG

SEQ ID NO: 721 - protein, 43 aa, Artificial Sequence
  Description of Artificial Sequence: Synthetic polypeptide
MCMPCFTTDHQMARACDDCCGGKGRGACYGPQCLCRGAGAAGG

SEQ ID NO: 722 - protein, 43 aa, Artificial Sequence
  Description of Artificial Sequence: Synthetic polypeptide
MCMPCFTTDHQMARRCDDCCGGKGRGACYGPQCLCRGAGAAGG

SEQ ID NO: 723 - protein, 43 aa, Artificial Sequence
  Description of Artificial Sequence: Synthetic polypeptide
MCMPCFTTDHQMARKCDDCCGGAGRGACYGPQCLCRGAGAAGG

SEQ ID NO: 724 - protein, 43 aa, Artificial Sequence
  Description of Artificial Sequence: Synthetic polypeptide
MCMPCFTTDHQMARACDDCCGGAGRGACYGPQCLCRGAGAAGG

SEQ ID NO: 725 - protein, 43 aa, Artificial Sequence
  Description of Artificial Sequence: Synthetic polypeptide
MCMPCFTTDHQMARRCDDCCGGAGRGACYGPQCLCRGAGAAGG

SEQ ID NO: 726 - protein, 43 aa, Artificial Sequence
  Description of Artificial Sequence: Synthetic polypeptide
MCMPCFTTDHQMARKCDDCCGGRGRGACYGPQCLCRGAGAAGG

SEQ ID NO: 727 - protein, 43 aa, Artificial Sequence
  Description of Artificial Sequence: Synthetic polypeptide
MCMPCFTTDHQMARACDDCCGGRGRGACYGPQCLCRGAGAAGG

SEQ ID NO: 728 - protein, 43 aa, Artificial Sequence
  Description of Artificial Sequence: Synthetic polypeptide
MCMPCFTTDHQMARRCDDCCGGRGRGACYGPQCLCRGAGAAGG

SEQ ID NO: 729 - protein, 43 aa, Artificial Sequence
  Description of Artificial Sequence: Synthetic polypeptide
MCMPCFTTDHQMARKCDDCCGGKGRGRCYGPQCLCRGAGAAGG

SEQ ID NO: 730 - protein, 43 aa, Artificial Sequence
  Description of Artificial Sequence: Synthetic polypeptide
MCMPCFTTDHQMARACDDCCGGKGRGRCYGPQCLCRGAGAAGG

SEQ ID NO: 731 - protein, 43 aa, Artificial Sequence
  Description of Artificial Sequence: Synthetic polypeptide
MCMPCFTTDHQMARRCDDCCGGKGRGRCYGPQCLCRGAGAAGG

SEQ ID NO: 732 - protein, 43 aa, Artificial Sequence
  Description of Artificial Sequence: Synthetic polypeptide
MCMPCFTTDHQMARKCDDCCGGAGRGRCYGPQCLCRGAGAAGG

SEQ ID NO: 733 - protein, 43 aa, Artificial Sequence
  Description of Artificial Sequence: Synthetic polypeptide
MCMPCFTTDHQMARACDDCCGGAGRGRCYGPQCLCRGAGAAGG

SEQ ID NO: 734 - protein, 43 aa, Artificial Sequence
  Description of Artificial Sequence: Synthetic polypeptide
MCMPCFTTDHQMARRCDDCCGGAGRGRCYGPQCLCRGAGAAGG

SEQ ID NO: 735 - protein, 43 aa, Artificial Sequence
  Description of Artificial Sequence: Synthetic polypeptide
MCMPCFTTDHQMARKCDDCCGGRGRGRCYGPQCLCRGAGAAGG

SEQ ID NO: 736 - protein, 43 aa, Artificial Sequence
  Description of Artificial Sequence: Synthetic polypeptide
MCMPCFTTDHQMARACDDCCGGRGRGRCYGPQCLCRGAGAAGG

SEQ ID NO: 737 - protein, 43 aa, Artificial Sequence
  Description of Artificial Sequence: Synthetic polypeptide
MCMPCFTTDHQMARRCDDCCGGRGRGRCYGPQCLCRGAGAAGG

SEQ ID NO: 738 - protein, 43 aa, Artificial Sequence
  Description of Artificial Sequence: Synthetic polypeptide
KCMPCFTTDHQMARRCDDCCGGRGRGRCYGPQCLCRGAGAAGG

SEQ ID NO: 739 - protein, 43 aa, Artificial Sequence
  Description of Artificial Sequence: Synthetic polypeptide
ACAPCFTTDHQAARRCDDCCGGRGRGRCYGPQCLCRGAGAAGG

SEQ ID NO: 740 - protein, 43 aa, Artificial Sequence
  Description of Artificial Sequence: Synthetic polypeptide
KCAPCFTTDHQAARRCDDCCGGRGRGRCYGPQCLCRGAGAAGG

SEQ ID NO: 741 - protein, 43 aa, Artificial Sequence
  Description of Artificial Sequence: Synthetic polypeptide
  MOD_RES (15)..(15): Citrulline
  MOD_RES (23)..(23): Citrulline
MCMPCFTTDHQMARXCDDCCGGXGRGKCYGPQCLCRGAGAAGG

SEQ ID NO: 742 - protein, 43 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
MCMPCFTTDHQMARXCDDCCGGXGRGXCYGPQCLCRGAGAAGG

SEQ ID NO: 743 - protein, 43 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
KCMPCFTTDHQMARXCDDCCGGXGRGXCYGPQCLCRGAGAAGG

SEQ ID NO: 744 - protein, 43 aa, Artificial Sequence
  Description of Artificial Sequence: Synthetic polypeptide
  MOD_RES (15)..(15): Citrulline
  MOD_RES (23)..(23): Citrulline
ACAPCFTTDHQAARXCDDCCGGXGRGKCYGPQCLCRGAGAAGG

SEQ ID NO: 745 - protein, 43 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
ACAPCFTTDHQAARXCDDCCGGXGRGXCYGPQCLCRGAGAAGG

SEQ ID NO: 746 - protein, 43 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
KCAPCFTTDHQAARXCDDCCGGXGRGXCYGPQCLCRGAGAAGG

SEQ ID NO: 747 - protein, 36 aa, Artificial Sequence
  Description of Artificial Sequence: Synthetic polypeptide
MCMPCFTTDHQMVRKCDDCCGGKGRGKCYGPQCLCR

SEQ ID NO: 748 - protein, 36 aa, Artificial Sequence
  Description of Artificial Sequence: Synthetic polypeptide
MCMPCFTTDHQMVRVCDDCCGGKGRGKCYGPQCLCR

SEQ ID NO: 749 - protein, 36 aa, Artificial Sequence
  Description of Artificial Sequence: Synthetic polypeptide
MCMPCFTTDHQMVRRCDDCCGGKGRGKCYGPQCLCR

SEQ ID NO: 750 - protein, 36 aa, Artificial Sequence
  Description of Artificial Sequence: Synthetic polypeptide
MCMPCFTTDHQMVRKCDDCCGGVGRGKCYGPQCLCR

SEQ ID NO: 751 - protein, 36 aa, Artificial Sequence
  Description of Artificial Sequence: Synthetic polypeptide
MCMPCFTTDHQMVRVCDDCCGGVGRGKCYGPQCLCR

SEQ ID NO: 752 - protein, 36 aa, Artificial Sequence
  Description of Artificial Sequence: Synthetic polypeptide
MCMPCFTTDHQMVRRCDDCCGGVGRGKCYGPQCLCR

SEQ ID NO: 753 - protein, 36 aa, Artificial Sequence
  Description of Artificial Sequence: Synthetic polypeptide
MCMPCFTTDHQMVRKCDDCCGGRGRGKCYGPQCLCR

SEQ ID NO: 754 - protein, 36 aa, Artificial Sequence
  Description of Artificial Sequence: Synthetic polypeptide
MCMPCFTTDHQMVRVCDDCCGGRGRGKCYGPQCLCR

SEQ ID NO: 755 - protein, 36 aa, Artificial Sequence
  Description of Artificial Sequence: Synthetic polypeptide
MCMPCFTTDHQMVRRCDDCCGGRGRGKCYGPQCLCR

SEQ ID NO: 756 - protein, 36 aa, Artificial Sequence
  Description of Artificial Sequence: Synthetic polypeptide
MCMPCFTTDHQMVRKCDDCCGGKGRGVCYGPQCLCR

SEQ ID NO: 757 - protein, 36 aa, Artificial Sequence
  Description of Artificial Sequence: Synthetic polypeptide
MCMPCFTTDHQMVRVCDDCCGGKGRGVCYGPQCLCR

SEQ ID NO: 758 - protein, 36 aa, Artificial Sequence
  Description of Artificial Sequence: Synthetic polypeptide
MCMPCFTTDHQMVRRCDDCCGGKGRGVCYGPQCLCR

SEQ ID NO: 759 - protein, 36 aa, Artificial Sequence
  Description of Artificial Sequence: Synthetic polypeptide
MCMPCFTTDHQMVRKCDDCCGGVGRGVCYGPQCLCR

SEQ ID NO: 760 - protein, 36 aa, Artificial Sequence
  Description of Artificial Sequence: Synthetic polypeptide
MCMPCFTTDHQMVRVCDDCCGGVGRGVCYGPQCLCR

SEQ ID NO: 761 - protein, 36 aa, Artificial Sequence
  Description of Artificial Sequence: Synthetic polypeptide
MCMPCFTTDHQMVRRCDDCCGGVGRGVCYGPQCLCR

SEQ ID NO: 762 - protein, 36 aa, Artificial Sequence
  Description of Artificial Sequence: Synthetic polypeptide
MCMPCFTTDHQMVRKCDDCCGGRGRGVCYGPQCLCR

SEQ ID NO: 763 - protein, 36 aa, Artificial Sequence
  Description of Artificial Sequence: Synthetic polypeptide
MCMPCFTTDHQMVRVCDDCCGGRGRGVCYGPQCLCR

SEQ ID NO: 764 - protein, 36 aa, Artificial Sequence
  Description of Artificial Sequence: Synthetic polypeptide
MCMPCFTTDHQMVRRCDDCCGGRGRGVCYGPQCLCR

SEQ ID NO: 765 - protein, 36 aa, Artificial Sequence
  Description of Artificial Sequence: Synthetic polypeptide
MCMPCFTTDHQMVRKCDDCCGGKGRGRCYGPQCLCR

SEQ ID NO: 766 - protein, 36 aa, Artificial Sequence
  Description of Artificial Sequence: Synthetic polypeptide
MCMPCFTTDHQMVRVCDDCCGGKGRGRCYGPQCLCR

SEQ ID NO: 767 - protein, 36 aa, Artificial Sequence
  Description of Artificial Sequence: Synthetic polypeptide
MCMPCFTTDHQMVRRCDDCCGGKGRGRCYGPQCLCR

SEQ ID NO: 768 - protein, 36 aa, Artificial Sequence
  Description of Artificial Sequence: Synthetic polypeptide
MCMPCFTTDHQMVRKCDDCCGGVGRGRCYGPQCLCR

SEQ ID NO: 769 - protein, 36 aa, Artificial Sequence
  Description of Artificial Sequence: Synthetic polypeptide
MCMPCFTTDHQMVRVCDDCCGGVGRGRCYGPQCLCR

SEQ ID NO: 770 - protein, 36 aa, Artificial Sequence
  Description of Artificial Sequence: Synthetic polypeptide
MCMPCFTTDHQMVRRCDDCCGGVGRGRCYGPQCLCR

SEQ ID NO: 771 - protein, 36 aa, Artificial Sequence
  Description of Artificial Sequence: Synthetic polypeptide
MCMPCFTTDHQMVRKCDDCCGGRGRGRCYGPQCLCR

SEQ ID NO: 772 - protein, 36 aa, Artificial Sequence
  Description of Artificial Sequence: Synthetic polypeptide
MCMPCFTTDHQMVRVCDDCCGGRGRGRCYGPQCLCR

SEQ ID NO: 773 - protein, 36 aa, Artificial Sequence
  Description of Artificial Sequence: Synthetic polypeptide
MCMPCFTTDHQMVRRCDDCCGGRGRGRCYGPQCLCR

SEQ ID NO: 774 - protein, 36 aa, Artificial Sequence
  Description of Artificial Sequence: Synthetic polypeptide
KCMPCFTTDHQMVRRCDDCCGGRGRGRCYGPQCLCR

SEQ ID NO: 775 - protein, 36 aa, Artificial Sequence
  Description of Artificial Sequence: Synthetic polypeptide
VCVPCFTTDHQVVRRCDDCCGGRGRGRCYGPQCLCR

SEQ ID NO: 776 - protein, 36 aa, Artificial Sequence
  Description of Artificial Sequence: Synthetic polypeptide
KCVPCFTTDHQVVRRCDDCCGGRGRGRCYGPQCLCR

SEQ ID NO: 777 - protein, 36 aa, Artificial Sequence
  Description of Artificial Sequence: Synthetic polypeptide
  MOD_RES (15)..(15): Citrulline
  MOD_RES (23)..(23): Citrulline
MCMPCFTTDHQMVRXCDDCCGGXGRGKCYGPQCLCR

SEQ ID NO: 778 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
MCMPCFTTDHQMVRXCDDCCGGXGRGXCYGPQCLCR

SEQ ID NO: 779 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
KCMPCFTTDHQMVRXCDDCCGGXGRGXCYGPQCLCR

SEQ ID NO: 780 - protein, 36 aa, Artificial Sequence
  Description of Artificial Sequence: Synthetic polypeptide
  MOD_RES (15)..(15): Citrulline
  MOD_RES (23)..(23): Citrulline
VCVPCFTTDHQVVRXCDDCCGGXGRGKCYGPQCLCR

SEQ ID NO: 781 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
VCVPCFTTDHQVVRXCDDCCGGXGRGXCYGPQCLCR

SEQ ID NO: 782 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
KCVPCFTTDHQVVRXCDDCCGGXGRGXCYGPQCLCR

SEQ ID NO: 783 - protein, 43 aa, Artificial Sequence
  Description of Artificial Sequence: Synthetic polypeptide
MCMPCFTTDHQMVRKCDDCCGGKGRGKCYGPQCLCRGAGAAGG

SEQ ID NO: 784 - protein, 43 aa, Artificial Sequence
  Description of Artificial Sequence: Synthetic polypeptide
MCMPCFTTDHQMVRVCDDCCGGKGRGKCYGPQCLCRGAGAAGG

SEQ ID NO: 785 - protein, 43 aa, Artificial Sequence
  Description of Artificial Sequence: Synthetic polypeptide
MCMPCFTTDHQMVRRCDDCCGGKGRGKCYGPQCLCRGAGAAGG

SEQ ID NO: 786 - protein, 43 aa, Artificial Sequence
  Description of Artificial Sequence: Synthetic polypeptide
MCMPCFTTDHQMVRKCDDCCGGVGRGKCYGPQCLCRGAGAAGG

SEQ ID NO: 787 - protein, 43 aa, Artificial Sequence
  Description of Artificial Sequence: Synthetic polypeptide
MCMPCFTTDHQMVRVCDDCCGGVGRGKCYGPQCLCRGAGAAGG

SEQ ID NO: 788 - protein, 43 aa, Artificial Sequence
  Description of Artificial Sequence: Synthetic polypeptide
MCMPCFTTDHQMVRRCDDCCGGVGRGKCYGPQCLCRGAGAAGG

SEQ ID NO: 789 - protein, 43 aa, Artificial Sequence
  Description of Artificial Sequence: Synthetic polypeptide
MCMPCFTTDHQMVRKCDDCCGGRGRGKCYGPQCLCRGAGAAGG

SEQ ID NO: 790 - protein, 43 aa, Artificial Sequence
  Description of Artificial Sequence: Synthetic polypeptide
MCMPCFTTDHQMVRVCDDCCGGRGRGKCYGPQCLCRGAGAAGG

SEQ ID NO: 791 - protein, 43 aa, Artificial Sequence
  Description of Artificial Sequence: Synthetic polypeptide
MCMPCFTTDHQMVRRCDDCCGGRGRGKCYGPQCLCRGAGAAGG

SEQ ID NO: 792 - protein, 43 aa, Artificial Sequence
  Description of Artificial Sequence: Synthetic polypeptide
MCMPCFTTDHQMVRKCDDCCGGKGRGVCYGPQCLCRGAGAAGG

SEQ ID NO: 793 - protein, 43 aa, Artificial Sequence
  Description of Artificial Sequence: Synthetic polypeptide
MCMPCFTTDHQMVRVCDDCCGGKGRGVCYGPQCLCRGAGAAGG

SEQ ID NO: 794 - protein, 43 aa, Artificial Sequence
  Description of Artificial Sequence: Synthetic polypeptide
MCMPCFTTDHQMVRRCDDCCGGKGRGVCYGPQCLCRGAGAAGG

SEQ ID NO: 795 - protein, 43 aa, Artificial Sequence
  Description of Artificial Sequence: Synthetic polypeptide
MCMPCFTTDHQMVRKCDDCCGGVGRGVCYGPQCLCRGAGAAGG

SEQ ID NO: 796 - protein, 43 aa, Artificial Sequence
  Description of Artificial Sequence: Synthetic polypeptide
MCMPCFTTDHQMVRVCDDCCGGVGRGVCYGPQCLCRGAGAAGG

SEQ ID NO: 797 - protein, 43 aa, Artificial Sequence
  Description of Artificial Sequence: Synthetic polypeptide
MCMPCFTTDHQMVRRCDDCCGGVGRGVCYGPQCLCRGAGAAGG

SEQ ID NO: 798 - protein, 43 aa, Artificial Sequence
  Description of Artificial Sequence: Synthetic polypeptide
MCMPCFTTDHQMVRKCDDCCGGRGRGVCYGPQCLCRGAGAAGG

SEQ ID NO: 799 - protein, 43 aa, Artificial Sequence
  Description of Artificial Sequence: Synthetic polypeptide
MCMPCFTTDHQMVRVCDDCCGGRGRGVCYGPQCLCRGAGAAGG

SEQ ID NO: 800 - protein, 43 aa, Artificial Sequence
  Description of Artificial Sequence: Synthetic polypeptide
MCMPCFTTDHQMVRRCDDCCGGRGRGVCYGPQCLCRGAGAAGG

SEQ ID NO: 801 - protein, 43 aa, Artificial Sequence
  Description of Artificial Sequence: Synthetic polypeptide
MCMPCFTTDHQMVRKCDDCCGGKGRGRCYGPQCLCRGAGAAGG

SEQ ID NO: 802 - protein, 43 aa, Artificial Sequence
  Description of Artificial Sequence: Synthetic polypeptide
MCMPCFTTDHQMVRVCDDCCGGKGRGRCYGPQCLCRGAGAAGG

SEQ ID NO: 803 - protein, 43 aa, Artificial Sequence
  Description of Artificial Sequence: Synthetic polypeptide
MCMPCFTTDHQMVRRCDDCCGGKGRGRCYGPQCLCRGAGAAGG

SEQ ID NO: 804 - protein, 43 aa, Artificial Sequence
  Description of Artificial Sequence: Synthetic polypeptide
MCMPCFTTDHQMVRKCDDCCGGVGRGRCYGPQCLCRGAGAAGG

SEQ ID NO: 805 - protein, 43 aa, Artificial Sequence
  Description of Artificial Sequence: Synthetic polypeptide
MCMPCFTTDHQMVRVCDDCCGGVGRGRCYGPQCLCRGAGAAGG

SEQ ID NO: 806 - protein, 43 aa, Artificial Sequence
  Description of Artificial Sequence: Synthetic polypeptide
MCMPCFTTDHQMVRRCDDCCGGVGRGRCYGPQCLCRGAGAAGG

SEQ ID NO: 807 - protein, 43 aa, Artificial Sequence
  Description of Artificial Sequence: Synthetic polypeptide
MCMPCFTTDHQMVRKCDDCCGGRGRGRCYGPQCLCRGAGAAGG

SEQ ID NO: 808 - protein, 43 aa, Artificial Sequence
  Description of Artificial Sequence: Synthetic polypeptide
MCMPCFTTDHQMVRVCDDCCGGRGRGRCYGPQCLCRGAGAAGG

SEQ ID NO: 809 - protein, 43 aa, Artificial Sequence
  Description of Artificial Sequence: Synthetic polypeptide
MCMPCFTTDHQMVRRCDDCCGGRGRGRCYGPQCLCRGAGAAGG

SEQ ID NO: 810 - protein, 43 aa, Artificial Sequence
  Description of Artificial Sequence: Synthetic polypeptide
KCMPCFTTDHQMVRRCDDCCGGRGRGRCYGPQCLCRGAGAAGG

SEQ ID NO: 811 - protein, 43 aa, Artificial Sequence
  Description of Artificial Sequence: Synthetic polypeptide
VCVPCFTTDHQVVRRCDDCCGGRGRGRCYGPQCLCRGAGAAGG

SEQ ID NO: 812 - protein, 43 aa, Artificial Sequence
  Description of Artificial Sequence: Synthetic polypeptide
KCVPCFTTDHQVVRRCDDCCGGRGRGRCYGPQCLCRGAGAAGG

SEQ ID NO: 813 - protein, 43 aa, Artificial Sequence
  Description of Artificial Sequence: Synthetic polypeptide
  MOD_RES (15)..(15): Citrulline
  MOD_RES (23)..(23): Citrulline
MCMPCFTTDHQMVRXCDDCCGGXGRGKCYGPQCLCRGAGAAGG

SEQ ID NO: 814 - protein, 43 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
MCMPCFTTDHQMVRXCDDCCGGXGRGXCYGPQCLCRGAGAAGG

SEQ ID NO: 815 - protein, 43 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
KCMPCFTTDHQMVRXCDDCCGGXGRGXCYGPQCLCRGAGAAGG

SEQ ID NO: 816 - protein, 43 aa, Artificial Sequence
  Description of Artificial Sequence: Synthetic polypeptide
  MOD_RES (15)..(15): Citrulline
  MOD_RES (23)..(23): Citrulline
VCVPCFTTDHQVVRXCDDCCGGXGRGKCYGPQCLCRGAGAAGG

SEQ ID NO: 817 - protein, 43 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
VCVPCFTTDHQVVRXCDDCCGGXGRGXCYGPQCLCRGAGAAGG

SEQ ID NO: 818 - protein, 43 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
KCVPCFTTDHQVVRXCDDCCGGXGRGXCYGPQCLCRGAGAAGG

SEQ ID NO: 819 - protein, 36 aa, Artificial Sequence
  Description of Artificial Sequence: Synthetic polypeptide
MCMPCFTTDHQMLRKCDDCCGGKGRGKCYGPQCLCR

SEQ ID NO: 820 - protein, 36 aa, Artificial Sequence
  Description of Artificial Sequence: Synthetic polypeptide
MCMPCFTTDHQMLRLCDDCCGGKGRGKCYGPQCLCR

SEQ ID NO: 821 - protein, 36 aa, Artificial Sequence
  Description of Artificial Sequence: Synthetic polypeptide
MCMPCFTTDHQMLRRCDDCCGGKGRGKCYGPQCLCR

SEQ ID NO: 822 - protein, 36 aa, Artificial Sequence
  Description of Artificial Sequence: Synthetic polypeptide
MCMPCFTTDHQMLRKCDDCCGGLGRGKCYGPQCLCR

SEQ ID NO: 823 - protein, 36 aa, Artificial Sequence
  Description of Artificial Sequence: Synthetic polypeptide
MCMPCFTTDHQMLRLCDDCCGGLGRGKCYGPQCLCR

SEQ ID NO: 824 - protein, 36 aa, Artificial Sequence
  Description of Artificial Sequence: Synthetic polypeptide
MCMPCFTTDHQMLRRCDDCCGGLGRGKCYGPQCLCR

SEQ ID NO: 825 - protein, 36 aa, Artificial Sequence
  Description of Artificial Sequence: Synthetic polypeptide
MCMPCFTTDHQMLRKCDDCCGGRGRGKCYGPQCLCR

SEQ ID NO: 826 - protein, 36 aa, Artificial Sequence
  Description of Artificial Sequence: Synthetic polypeptide
MCMPCFTTDHQMLRLCDDCCGGRGRGKCYGPQCLCR

SEQ ID NO: 827 - protein, 36 aa, Artificial Sequence
  Description of Artificial Sequence: Synthetic polypeptide
MCMPCFTTDHQMLRRCDDCCGGRGRGKCYGPQCLCR

SEQ ID NO: 828 - protein, 36 aa, Artificial Sequence
  Description of Artificial Sequence: Synthetic polypeptide
MCMPCFTTDHQMLRKCDDCCGGKGRGLCYGPQCLCR

SEQ ID NO: 829 - protein, 36 aa, Artificial Sequence
  Description of Artificial Sequence: Synthetic polypeptide
MCMPCFTTDHQMLRLCDDCCGGKGRGLCYGPQCLCR

SEQ ID NO: 830 - protein, 36 aa, Artificial Sequence
  Description of Artificial Sequence: Synthetic polypeptide
MCMPCFTTDHQMLRRCDDCCGGKGRGLCYGPQCLCR

SEQ ID NO: 831 - protein, 36 aa, Artificial Sequence
  Description of Artificial Sequence: Synthetic polypeptide
MCMPCFTTDHQMLRKCDDCCGGLGRGLCYGPQCLCR

SEQ ID NO: 832 - protein, 36 aa, Artificial Sequence
  Description of Artificial Sequence: Synthetic polypeptide
MCMPCFTTDHQMLRLCDDCCGGLGRGLCYGPQCLCR

SEQ ID NO: 833 - protein, 36 aa, Artificial Sequence
  Description of Artificial Sequence: Synthetic polypeptide
MCMPCFTTDHQMLRRCDDCCGGLGRGLCYGPQCLCR

SEQ ID NO: 834 - protein, 36 aa, Artificial Sequence
  Description of Artificial Sequence: Synthetic polypeptide
MCMPCFTTDHQMLRKCDDCCGGRGRGLCYGPQCLCR

SEQ ID NO: 835 - protein, 36 aa, Artificial Sequence
  Description of Artificial Sequence: Synthetic polypeptide
MCMPCFTTDHQMLRLCDDCCGGRGRGLCYGPQCLCR

SEQ ID NO: 836 - protein, 36 aa, Artificial Sequence
  Description of Artificial Sequence: Synthetic polypeptide
MCMPCFTTDHQMLRRCDDCCGGRGRGLCYGPQCLCR

SEQ ID NO: 837 - protein, 36 aa, Artificial Sequence
  Description of Artificial Sequence: Synthetic polypeptide
MCMPCFTTDHQMLRKCDDCCGGKGRGRCYGPQCLCR

SEQ ID NO: 838 - protein, 36 aa, Artificial Sequence
  Description of Artificial Sequence: Synthetic polypeptide
MCMPCFTTDHQMLRLCDDCCGGKGRGRCYGPQCLCR

SEQ ID NO: 839 - protein, 36 aa, Artificial Sequence
  Description of Artificial Sequence: Synthetic polypeptide
MCMPCFTTDHQMLRRCDDCCGGKGRGRCYGPQCLCR

SEQ ID NO: 840 - protein, 36 aa, Artificial Sequence
  Description of Artificial Sequence: Synthetic polypeptide
MCMPCFTTDHQMLRKCDDCCGGLGRGRCYGPQCLCR

SEQ ID NO: 841 - protein, 36 aa, Artificial Sequence
  Description of Artificial Sequence: Synthetic polypeptide
MCMPCFTTDHQMLRLCDDCCGGLGRGRCYGPQCLCR

SEQ ID NO: 842 - protein, 36 aa, Artificial Sequence
  Description of Artificial Sequence: Synthetic polypeptide
MCMPCFTTDHQMLRRCDDCCGGLGRGRCYGPQCLCR

SEQ ID NO: 843 - protein, 36 aa, Artificial Sequence
  Description of Artificial Sequence: Synthetic polypeptide
MCMPCFTTDHQMLRKCDDCCGGRGRGRCYGPQCLCR

SEQ ID NO: 844 - protein, 36 aa, Artificial Sequence
  Description of Artificial Sequence: Synthetic polypeptide
MCMPCFTTDHQMLRLCDDCCGGRGRGRCYGPQCLCR

SEQ ID NO: 845 - protein, 36 aa, Artificial Sequence
  Description of Artificial Sequence: Synthetic polypeptide
MCMPCFTTDHQMLRRCDDCCGGRGRGRCYGPQCLCR

SEQ ID NO: 846 - protein, 36 aa, Artificial Sequence
  Description of Artificial Sequence: Synthetic polypeptide
KCMPCFTTDHQMLRRCDDCCGGRGRGRCYGPQCLCR

SEQ ID NO: 847 - protein, 36 aa, Artificial Sequence
  Description of Artificial Sequence: Synthetic polypeptide
LCLPCFTTDHQLLRRCDDCCGGRGRGRCYGPQCLCR

SEQ ID NO: 848 - protein, 36 aa, Artificial Sequence
  Description of Artificial Sequence: Synthetic polypeptide
KCLPCFTTDHQLLRRCDDCCGGRGRGRCYGPQCLCR

SEQ ID NO: 849 - protein, 36 aa, Artificial Sequence
  Description of Artificial Sequence: Synthetic polypeptide
  MOD_RES (15)..(15): Citrulline
  MOD_RES (23)..(23): Citrulline
MCMPCFTTDHQMLRXCDDCCGGXGRGKCYGPQCLCR

SEQ ID NO: 850 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
MCMPCFTTDHQMLRXCDDCCGGXGRGXCYGPQCLCR

SEQ ID NO: 851 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
KCMPCFTTDHQMLRXCDDCCGGXGRGXCYGPQCLCR

SEQ ID NO: 852 - protein, 36 aa, Artificial Sequence
  Description of Artificial Sequence: Synthetic polypeptide
  MOD_RES (15)..(15): Citrulline
  MOD_RES (23)..(23): Citrulline
LCLPCFTTDHQLLRXCDDCCGGXGRGKCYGPQCLCR

SEQ ID NO: 853 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
LCLPCFTTDHQLLRXCDDCCGGXGRGXCYGPQCLCR

SEQ ID NO: 854 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
KCLPCFTTDHQLLRXCDDCCGGXGRGXCYGPQCLCR

SEQ ID NO: 855 - protein, 43 aa, Artificial Sequence
  Description of Artificial Sequence: Synthetic polypeptide
MCMPCFTTDHQMLRKCDDCCGGKGRGKCYGPQCLCRGAGAAGG

SEQ ID NO: 856 - protein, 43 aa, Artificial Sequence
  Description of Artificial Sequence: Synthetic polypeptide
MCMPCFTTDHQMLRLCDDCCGGKGRGKCYGPQCLCRGAGAAGG

SEQ ID NO: 857 - protein, 43 aa, Artificial Sequence
  Description of Artificial Sequence: Synthetic polypeptide
MCMPCFTTDHQMLRRCDDCCGGKGRGKCYGPQCLCRGAGAAGG

SEQ ID NO: 858 - protein, 43 aa, Artificial Sequence
  Description of Artificial Sequence: Synthetic polypeptide
MCMPCFTTDHQMLRKCDDCCGGLGRGKCYGPQCLCRGAGAAGG

SEQ ID NO: 859 - protein, 43 aa, Artificial Sequence
  Description of Artificial Sequence: Synthetic polypeptide
MCMPCFTTDHQMLRLCDDCCGGLGRGKCYGPQCLCRGAGAAGG

SEQ ID NO: 860 - protein, 43 aa, Artificial Sequence
  Description of Artificial Sequence: Synthetic polypeptide
MCMPCFTTDHQMLRRCDDCCGGLGRGKCYGPQCLCRGAGAAGG

SEQ ID NO: 861 - protein, 43 aa, Artificial Sequence
  Description of Artificial Sequence: Synthetic polypeptide
MCMPCFTTDHQMLRKCDDCCGGRGRGKCYGPQCLCRGAGAAGG

SEQ ID NO: 862 - protein, 43 aa, Artificial Sequence
  Description of Artificial Sequence: Synthetic polypeptide
MCMPCFTTDHQMLRLCDDCCGGRGRGKCYGPQCLCRGAGAAGG

SEQ ID NO: 863 - protein, 43 aa, Artificial Sequence
  Description of Artificial Sequence: Synthetic polypeptide
MCMPCFTTDHQMLRRCDDCCGGRGRGKCYGPQCLCRGAGAAGG

SEQ ID NO: 864 - protein, 43 aa, Artificial Sequence
  Description of Artificial Sequence: Synthetic polypeptide
MCMPCFTTDHQMLRKCDDCCGGKGRGLCYGPQCLCRGAGAAGG

SEQ ID NO: 865 - protein, 43 aa, Artificial Sequence
  Description of Artificial Sequence: Synthetic polypeptide
MCMPCFTTDHQMLRLCDDCCGGKGRGLCYGPQCLCRGAGAAGG

SEQ ID NO: 866 - protein, 43 aa, Artificial Sequence
  Description of Artificial Sequence: Synthetic polypeptide
MCMPCFTTDHQMLRRCDDCCGGKGRGLCYGPQCLCRGAGAAGG

SEQ ID NO: 867 - protein, 43 aa, Artificial Sequence
  Description of Artificial Sequence: Synthetic polypeptide
MCMPCFTTDHQMLRKCDDCCGGLGRGLCYGPQCLCRGAGAAGG

SEQ ID NO: 868 - protein, 43 aa, Artificial Sequence
  Description of Artificial Sequence: Synthetic polypeptide
MCMPCFTTDHQMLRLCDDCCGGLGRGLCYGPQCLCRGAGAAGG

SEQ ID NO: 869 - protein, 43 aa, Artificial Sequence
  Description of Artificial Sequence: Synthetic polypeptide
MCMPCFTTDHQMLRRCDDCCGGLGRGLCYGPQCLCRGAGAAGG

SEQ ID NO: 870 - protein, 43 aa, Artificial Sequence
  Description of Artificial Sequence: Synthetic polypeptide
MCMPCFTTDHQMLRKCDDCCGGRGRGLCYGPQCLCRGAGAAGG

SEQ ID NO: 871 - protein, 43 aa, Artificial Sequence
  Description of Artificial Sequence: Synthetic polypeptide
MCMPCFTTDHQMLRLCDDCCGGRGRGLCYGPQCLCRGAGAAGG

SEQ ID NO: 872 - protein, 43 aa, Artificial Sequence
  Description of Artificial Sequence: Synthetic polypeptide
MCMPCFTTDHQMLRRCDDCCGGRGRGLCYGPQCLCRGAGAAGG

SEQ ID NO: 873 - protein, 43 aa, Artificial Sequence
  Description of Artificial Sequence: Synthetic polypeptide
MCMPCFTTDHQMLRKCDDCCGGKGRGRCYGPQCLCRGAGAAGG

SEQ ID NO: 874 - protein, 43 aa, Artificial Sequence
  Description of Artificial Sequence: Synthetic polypeptide
MCMPCFTTDHQMLRLCDDCCGGKGRGRCYGPQCLCRGAGAAGG

SEQ ID NO: 875 - protein, 43 aa, Artificial Sequence
  Description of Artificial Sequence: Synthetic polypeptide
MCMPCFTTDHQMLRRCDDCCGGKGRGRCYGPQCLCRGAGAAGG

SEQ ID NO: 876 - protein, 43 aa, Artificial Sequence
  Description of Artificial Sequence: Synthetic polypeptide
MCMPCFTTDHQMLRKCDDCCGGLGRGRCYGPQCLCRGAGAAGG

SEQ ID NO: 877 - protein, 43 aa, Artificial Sequence
  Description of Artificial Sequence: Synthetic polypeptide
MCMPCFTTDHQMLRLCDDCCGGLGRGRCYGPQCLCRGAGAAGG

SEQ ID NO: 878 - protein, 43 aa, Artificial Sequence
  Description of Artificial Sequence: Synthetic polypeptide
MCMPCFTTDHQMLRRCDDCCGGLGRGRCYGPQCLCRGAGAAGG

SEQ ID NO: 879 - protein, 43 aa, Artificial Sequence
  Description of Artificial Sequence: Synthetic polypeptide
MCMPCFTTDHQMLRKCDDCCGGRGRGRCYGPQCLCRGAGAAGG

SEQ ID NO: 880 - protein, 43 aa, Artificial Sequence
  Description of Artificial Sequence: Synthetic polypeptide
MCMPCFTTDHQMLRLCDDCCGGRGRGRCYGPQCLCRGAGAAGG

SEQ ID NO: 881 - protein, 43 aa, Artificial Sequence
  Description of Artificial Sequence: Synthetic polypeptide
MCMPCFTTDHQMLRRCDDCCGGRGRGRCYGPQCLCRGAGAAGG

SEQ ID NO: 882 - protein, 43 aa, Artificial Sequence
  Description of Artificial Sequence: Synthetic polypeptide
KCMPCFTTDHQMLRRCDDCCGGRGRGRCYGPQCLCRGAGAAGG

SEQ ID NO: 883 - protein, 43 aa, Artificial Sequence
  Description of Artificial Sequence: Synthetic polypeptide
LCLPCFTTDHQLLRRCDDCCGGRGRGRCYGPQCLCRGAGAAGG

SEQ ID NO: 884 - protein, 43 aa, Artificial Sequence
  Description of Artificial Sequence: Synthetic polypeptide
KCLPCFTTDHQLLRRCDDCCGGRGRGRCYGPQCLCRGAGAAGG

SEQ ID NO: 885 - protein, 43 aa, Artificial Sequence
  Description of Artificial Sequence: Synthetic polypeptide
  MOD_RES (15)..(15): Citrulline
  MOD_RES (23)..(23): Citrulline
MCMPCFTTDHQMLRXCDDCCGGXGRGKCYGPQCLCRGAGAAGG

SEQ ID NO: 886 - protein, 43 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
MCMPCFTTDHQMLRXCDDCCGGXGRGXCYGPQCLCRGAGAAGG

SEQ ID NO: 887 - protein, 43 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
KCMPCFTTDHQMLRXCDDCCGGXGRGXCYGPQCLCRGAGAAGG

SEQ ID NO: 888 - protein, 43 aa, Artificial Sequence
  Description of Artificial Sequence: Synthetic polypeptide
  MOD_RES (15)..(15): Citrulline
  MOD_RES (23)..(23): Citrulline
LCLPCFTTDHQLLRXCDDCCGGXGRGKCYGPQCLCRGAGAAGG

SEQ ID NO: 889 - protein, 43 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
LCLPCFTTDHQLLRXCDDCCGGXGRGXCYGPQCLCRGAGAAGG

SEQ ID NO: 890 - protein, 43 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
KCLPCFTTDHQLLRXCDDCCGGXGRGXCYGPQCLCRGAGAAGG

SEQ ID NO: 891 - protein, 36 aa, Artificial Sequence
  Description of Artificial Sequence: Synthetic polypeptide
GCGPCFTTDHQGARKCDDCCGGKGRGKCYGPQCLCR

SEQ ID NO: 892 - protein, 36 aa, Artificial Sequence
  Description of Artificial Sequence: Synthetic polypeptide
GCGPCFTTDHQGARACDDCCGGKGRGKCYGPQCLCR

SEQ ID NO: 893 - protein, 36 aa, Artificial Sequence
  Description of Artificial Sequence: Synthetic polypeptide
GCGPCFTTDHQGARRCDDCCGGKGRGKCYGPQCLCR

SEQ ID NO: 894 - protein, 36 aa, Artificial Sequence
  Description of Artificial Sequence: Synthetic polypeptide
GCGPCFTTDHQGARKCDDCCGGAGRGKCYGPQCLCR

SEQ ID NO: 895 - protein, 36 aa, Artificial Sequence
  Description of Artificial Sequence: Synthetic polypeptide
GCGPCFTTDHQGARACDDCCGGAGRGKCYGPQCLCR

SEQ ID NO: 896 - protein, 36 aa, Artificial Sequence
  Description of Artificial Sequence: Synthetic polypeptide
GCGPCFTTDHQGARRCDDCCGGAGRGKCYGPQCLCR

SEQ ID NO: 897 - protein, 36 aa, Artificial Sequence
  Description of Artificial Sequence: Synthetic polypeptide
GCGPCFTTDHQGARKCDDCCGGRGRGKCYGPQCLCR

SEQ ID NO: 898 - protein, 36 aa, Artificial Sequence
  Description of Artificial Sequence: Synthetic polypeptide
GCGPCFTTDHQGARACDDCCGGRGRGKCYGPQCLCR

SEQ ID NO: 899 - protein, 36 aa, Artificial Sequence
  Description of Artificial Sequence: Synthetic polypeptide
GCGPCFTTDHQGARRCDDCCGGRGRGKCYGPQCLCR

SEQ ID NO: 900 - protein, 36 aa, Artificial Sequence
  Description of Artificial Sequence: Synthetic polypeptide
GCGPCFTTDHQGARKCDDCCGGKGRGACYGPQCLCR

SEQ ID NO: 901 - protein, 36 aa, Artificial Sequence
  Description of Artificial Sequence: Synthetic polypeptide
GCGPCFTTDHQGARACDDCCGGKGRGACYGPQCLCR

SEQ ID NO: 902 - protein, 36 aa, Artificial Sequence
  Description of Artificial Sequence: Synthetic polypeptide
GCGPCFTTDHQGARRCDDCCGGKGRGACYGPQCLCR

SEQ ID NO: 903 - protein, 36 aa, Artificial Sequence
  Description of Artificial Sequence: Synthetic polypeptide
GCGPCFTTDHQGARKCDDCCGGAGRGACYGPQCLCR

SEQ ID NO: 904 - protein, 36 aa, Artificial Sequence
  Description of Artificial Sequence: Synthetic polypeptide
GCGPCFTTDHQGARACDDCCGGAGRGACYGPQCLCR

SEQ ID NO: 905 - protein, 36 aa, Artificial Sequence
  Description of Artificial Sequence: Synthetic polypeptide
GCGPCFTTDHQGARRCDDCCGGAGRGACYGPQCLCR

SEQ ID NO: 906 - protein, 36 aa, Artificial Sequence
  Description of Artificial Sequence: Synthetic polypeptide
GCGPCFTTDHQGARKCDDCCGGRGRGACYGPQCLCR

SEQ ID NO: 907 - protein, 36 aa, Artificial Sequence
  Description of Artificial Sequence: Synthetic polypeptide
GCGPCFTTDHQGARACDDCCGGRGRGACYGPQCLCR

SEQ ID NO: 908 - protein, 36 aa, Artificial Sequence
  Description of Artificial Sequence: Synthetic polypeptide
GCGPCFTTDHQGARRCDDCCGGRGRGACYGPQCLCR

SEQ ID NO: 909 - protein, 36 aa, Artificial Sequence
  Description of Artificial Sequence: Synthetic polypeptide
GCGPCFTTDHQGARKCDDCCGGKGRGRCYGPQCLCR

SEQ ID NO: 910 - protein, 36 aa, Artificial Sequence
  Description of Artificial Sequence: Synthetic polypeptide
GCGPCFTTDHQGARACDDCCGGKGRGRCYGPQCLCR

SEQ ID NO: 911 - protein, 36 aa, Artificial Sequence
  Description of Artificial Sequence: Synthetic polypeptide
GCGPCFTTDHQGARRCDDCCGGKGRGRCYGPQCLCR

SEQ ID NO: 912 - protein, 36 aa, Artificial Sequence
  Description of Artificial Sequence: Synthetic polypeptide
GCGPCFTTDHQGARKCDDCCGGAGRGRCYGPQCLCR

SEQ ID NO: 913 - protein, 36 aa, Artificial Sequence
  Description of Artificial Sequence: Synthetic polypeptide
GCGPCFTTDHQGARACDDCCGGAGRGRCYGPQCLCR

SEQ ID NO: 914 - protein, 36 aa, Artificial Sequence
  Description of Artificial Sequence: Synthetic polypeptide
GCGPCFTTDHQGARRCDDCCGGAGRGRCYGPQCLCR

SEQ ID NO: 915 - protein, 36 aa, Artificial Sequence
  Description of Artificial Sequence: Synthetic polypeptide
GCGPCFTTDHQGARKCDDCCGGRGRGRCYGPQCLCR

SEQ ID NO: 916 - protein, 36 aa, Artificial Sequence
  Description of Artificial Sequence: Synthetic polypeptide
GCGPCFTTDHQGARACDDCCGGRGRGRCYGPQCLCR

SEQ ID NO: 917 - protein, 36 aa, Artificial Sequence
  Description of Artificial Sequence: Synthetic polypeptide
GCGPCFTTDHQGARRCDDCCGGRGRGRCYGPQCLCR

SEQ ID NO: 918 - protein, 36 aa, Artificial Sequence
  Description of Artificial Sequence: Synthetic polypeptide
KCGPCFTTDHQGARRCDDCCGGRGRGRCYGPQCLCR

SEQ ID NO: 919 - protein, 36 aa, Artificial Sequence
  Description of Artificial Sequence: Synthetic polypeptide
  MOD_RES (15)..(15): Citrulline
  MOD_RES (23)..(23): Citrulline
GCGPCFTTDHQGARXCDDCCGGXGRGKCYGPQCLCR

SEQ ID NO: 920 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
GCGPCFTTDHQGARXCDDCCGGXGRGXCYGPQCLCR

SEQ ID NO: 921 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
KCGPCFTTDHQGARXCDDCCGGXGRGXCYGPQCLCR

SEQ ID NO: 922 - protein, 36 aa, Artificial Sequence
  Description of Artificial Sequence: Synthetic polypeptide
ACAPCFTTDHQAARACDDCCGGKGRGKCYGPQCLCR

SEQ ID NO: 923 - protein, 36 aa, Artificial Sequence
  Description of Artificial Sequence: Synthetic polypeptide
ACAPCFTTDHQAARRCDDCCGGKGRGKCYGPQCLCR

SEQ ID NO: 924 - protein, 36 aa, Artificial Sequence
  Description of Artificial Sequence: Synthetic polypeptide
ACAPCFTTDHQAARKCDDCCGGAGRGKCYGPQCLCR

SEQ ID NO: 925 - protein, 36 aa, Artificial Sequence
  Description of Artificial Sequence: Synthetic polypeptide
ACAPCFTTDHQAARACDDCCGGAGRGKCYGPQCLCR

SEQ ID NO: 926 - protein, 36 aa, Artificial Sequence
  Description of Artificial Sequence: Synthetic polypeptide
ACAPCFTTDHQAARRCDDCCGGAGRGKCYGPQCLCR

SEQ ID NO: 927 - protein, 36 aa, Artificial Sequence
  Description of Artificial Sequence: Synthetic polypeptide
ACAPCFTTDHQAARKCDDCCGGRGRGKCYGPQCLCR

SEQ ID NO: 928 - protein, 36 aa, Artificial Sequence
  Description of Artificial Sequence: Synthetic polypeptide
ACAPCFTTDHQAARACDDCCGGRGRGKCYGPQCLCR

SEQ ID NO: 929 - protein, 36 aa, Artificial Sequence
  Description of Artificial Sequence: Synthetic polypeptide
ACAPCFTTDHQAARKCDDCCGGKGRGACYGPQCLCR

SEQ ID NO: 930 - protein, 36 aa, Artificial Sequence
  Description of Artificial Sequence: Synthetic polypeptide
ACAPCFTTDHQAARACDDCCGGKGRGACYGPQCLCR

SEQ ID NO: 931 - protein, 36 aa, Artificial Sequence
  Description of Artificial Sequence: Synthetic polypeptide
ACAPCFTTDHQAARRCDDCCGGKGRGACYGPQCLCR

SEQ ID NO: 932 - protein, 36 aa, Artificial Sequence
  Description of Artificial Sequence: Synthetic polypeptide
ACAPCFTTDHQAARKCDDCCGGAGRGACYGPQCLCR

SEQ ID NO: 933 - protein, 36 aa, Artificial Sequence
  Description of Artificial Sequence: Synthetic polypeptide
ACAPCFTTDHQAARACDDCCGGAGRGACYGPQCLCR

SEQ ID NO: 934 - protein, 36 aa, Artificial Sequence
  Description of Artificial Sequence: Synthetic polypeptide
ACAPCFTTDHQAARRCDDCCGGAGRGACYGPQCLCR

SEQ ID NO: 935 - protein, 36 aa, Artificial Sequence
  Description of Artificial Sequence: Synthetic polypeptide
ACAPCFTTDHQAARKCDDCCGGRGRGACYGPQCLCR

SEQ ID NO: 936 - protein, 36 aa, Artificial Sequence
  Description of Artificial Sequence: Synthetic polypeptide
ACAPCFTTDHQAARACDDCCGGRGRGACYGPQCLCR

SEQ ID NO: 937 - protein, 36 aa, Artificial Sequence
  Description of Artificial Sequence: Synthetic polypeptide
ACAPCFTTDHQAARRCDDCCGGRGRGACYGPQCLCR

SEQ ID NO: 938 - protein, 36 aa, Artificial Sequence
  Description of Artificial Sequence: Synthetic polypeptide
ACAPCFTTDHQAARKCDDCCGGKGRGRCYGPQCLCR

SEQ ID NO: 939 - protein, 36 aa, Artificial Sequence
  Description of Artificial Sequence: Synthetic polypeptide
ACAPCFTTDHQAARACDDCCGGKGRGRCYGPQCLCR

SEQ ID NO: 940 - protein, 36 aa, Artificial Sequence
  Description of Artificial Sequence: Synthetic polypeptide
ACAPCFTTDHQAARRCDDCCGGKGRGRCYGPQCLCR

SEQ ID NO: 941 - protein, 36 aa, Artificial Sequence
  Description of Artificial Sequence: Synthetic polypeptide
ACAPCFTTDHQAARKCDDCCGGAGRGRCYGPQCLCR

SEQ ID NO: 942 - protein, 36 aa, Artificial Sequence
  Description of Artificial Sequence: Synthetic polypeptide
ACAPCFTTDHQAARACDDCCGGAGRGRCYGPQCLCR

SEQ ID NO: 943 - protein, 36 aa, Artificial Sequence
  Description of Artificial Sequence: Synthetic polypeptide
ACAPCFTTDHQAARRCDDCCGGAGRGRCYGPQCLCR

SEQ ID NO: 944 - protein, 36 aa, Artificial Sequence
  Description of Artificial Sequence: Synthetic polypeptide
ACAPCFTTDHQAARKCDDCCGGRGRGRCYGPQCLCR

SEQ ID NO: 945 - protein, 36 aa, Artificial Sequence
  Description of Artificial Sequence: Synthetic polypeptide
ACAPCFTTDHQAARACDDCCGGRGRGRCYGPQCLCR

SEQ ID NO: 946 - protein, 36 aa, Artificial Sequence
  Description of Artificial Sequence: Synthetic polypeptide
ICIPCFTTDHQIARKCDDCCGGKGRGKCYGPQCLCR

SEQ ID NO: 947 - protein, 36 aa, Artificial Sequence
  Description of Artificial Sequence: Synthetic polypeptide
ICIPCFTTDHQIARACDDCCGGKGRGKCYGPQCLCR

SEQ ID NO: 948 - protein, 36 aa, Artificial Sequence
  Description of Artificial Sequence: Synthetic polypeptide
ICIPCFTTDHQIARRCDDCCGGKGRGKCYGPQCLCR

SEQ ID NO: 949 - protein, 36 aa, Artificial Sequence
  Description of Artificial Sequence: Synthetic polypeptide
ICIPCFTTDHQIARKCDDCCGGAGRGKCYGPQCLCR

SEQ ID NO: 950 - protein, 36 aa, Artificial Sequence
  Description of Artificial Sequence: Synthetic polypeptide
ICIPCFTTDHQIARACDDCCGGAGRGKCYGPQCLCR

SEQ ID NO: 951 - protein, 36 aa, Artificial Sequence
  Description of Artificial Sequence: Synthetic polypeptide
ICIPCFTTDHQIARRCDDCCGGAGRGKCYGPQCLCR

SEQ ID NO: 952 - protein, 36 aa, Artificial Sequence
  Description of Artificial Sequence: Synthetic polypeptide
ICIPCFTTDHQIARKCDDCCGGRGRGKCYGPQCLCR

SEQ ID NO: 953 - protein, 36 aa, Artificial Sequence
  Description of Artificial Sequence: Synthetic polypeptide
ICIPCFTTDHQIARACDDCCGGRGRGKCYGPQCLCR

SEQ ID NO: 954 - protein, 36 aa, Artificial Sequence
  Description of Artificial Sequence: Synthetic polypeptide
ICIPCFTTDHQIARKCDDCCGGKGRGACYGPQCLCR

SEQ ID NO: 955 - protein, 36 aa, Artificial Sequence
  Description of Artificial Sequence: Synthetic polypeptide
ICIPCFTTDHQIARACDDCCGGKGRGACYGPQCLCR

SEQ ID NO: 956 - protein, 36 aa, Artificial Sequence
  Description of Artificial Sequence: Synthetic polypeptide
ICIPCFTTDHQIARRCDDCCGGKGRGACYGPQCLCR

SEQ ID NO: 957 - protein, 36 aa, Artificial Sequence
  Description of Artificial Sequence: Synthetic polypeptide
ICIPCFTTDHQIARKCDDCCGGAGRGACYGPQCLCR

SEQ ID NO: 958 - protein, 36 aa, Artificial Sequence
  Description of Artificial Sequence: Synthetic polypeptide
ICIPCFTTDHQIARACDDCCGGAGRGACYGPQCLCR

SEQ ID NO: 959 - protein, 36 aa, Artificial Sequence
  Description of Artificial Sequence: Synthetic polypeptide
ICIPCFTTDHQIARRCDDCCGGAGRGACYGPQCLCR

SEQ ID NO: 960 - protein, 36 aa, Artificial Sequence
  Description of Artificial Sequence: Synthetic polypeptide
ICIPCFTTDHQIARKCDDCCGGRGRGACYGPQCLCR

SEQ ID NO: 961 - protein, 36 aa, Artificial Sequence
  Description of Artificial Sequence: Synthetic polypeptide
ICIPCFTTDHQIARACDDCCGGRGRGACYGPQCLCR

SEQ ID NO: 962 - protein, 36 aa, Artificial Sequence
  Description of Artificial Sequence: Synthetic polypeptide
ICIPCFTTDHQIARRCDDCCGGRGRGACYGPQCLCR

SEQ ID NO: 963 - protein, 36 aa, Artificial Sequence
  Description of Artificial Sequence: Synthetic polypeptide
ICIPCFTTDHQIARKCDDCCGGKGRGRCYGPQCLCR

SEQ ID NO: 964 - protein, 36 aa, Artificial Sequence
  Description of Artificial Sequence: Synthetic polypeptide
ICIPCFTTDHQIARACDDCCGGKGRGRCYGPQCLCR

SEQ ID NO: 965 - protein, 36 aa, Artificial Sequence
  Description of Artificial Sequence: Synthetic polypeptide
ICIPCFTTDHQIARRCDDCCGGKGRGRCYGPQCLCR

SEQ ID NO: 966 - protein, 36 aa, Artificial Sequence
  Description of Artificial Sequence: Synthetic polypeptide
ICIPCFTTDHQIARKCDDCCGGAGRGRCYGPQCLCR

SEQ ID NO: 967 - protein, 36 aa, Artificial Sequence
  Description of Artificial Sequence: Synthetic polypeptide
ICIPCFTTDHQIARACDDCCGGAGRGRCYGPQCLCR

SEQ ID NO: 968 - protein, 36 aa, Artificial Sequence
  Description of Artificial Sequence: Synthetic polypeptide
ICIPCFTTDHQIARRCDDCCGGAGRGRCYGPQCLCR

SEQ ID NO: 969 - protein, 36 aa, Artificial Sequence
  Description of Artificial Sequence: Synthetic polypeptide
ICIPCFTTDHQIARKCDDCCGGRGRGRCYGPQCLCR

SEQ ID NO: 970 - protein, 36 aa, Artificial Sequence
  Description of Artificial Sequence: Synthetic polypeptide
ICIPCFTTDHQIARACDDCCGGRGRGRCYGPQCLCR

SEQ ID NO: 971 - protein, 36 aa, Artificial Sequence
  Description of Artificial Sequence: Synthetic polypeptide
ICIPCFTTDHQIARRCDDCCGGRGRGRCYGPQCLCR

SEQ ID NO: 972 - protein, 36 aa, Artificial Sequence
  Description of Artificial Sequence: Synthetic polypeptide
KCIPCFTTDHQIARRCDDCCGGRGRGRCYGPQCLCR

SEQ ID NO: 973 - protein, 36 aa, Artificial Sequence
  Description of Artificial Sequence: Synthetic polypeptide
  MOD_RES (15)..(15): Citrulline
  MOD_RES (23)..(23): Citrulline
ICIPCFTTDHQIARXCDDCCGGXGRGKCYGPQCLCR

SEQ ID NO: 974 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
ICIPCFTTDHQIARXCDDCCGGXGRGXCYGPQCLCR

SEQ ID NO: 975 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
KCIPCFTTDHQIARXCDDCCGGXGRGXCYGPQCLCR

SEQ ID NO: 976 - protein, 36 aa, Artificial Sequence
  Description of Artificial Sequence: Synthetic polypeptide
TCTPCFTTDHQTARKCDDCCGGKGRGKCYGPQCLCR

SEQ ID NO: 977 - protein, 36 aa, Artificial Sequence
  Description of Artificial Sequence: Synthetic polypeptide
TCTPCFTTDHQTARACDDCCGGKGRGKCYGPQCLCR

SEQ ID NO: 978 - protein, 36 aa, Artificial Sequence
  Description of Artificial Sequence: Synthetic polypeptide
TCTPCFTTDHQTARRCDDCCGGKGRGKCYGPQCLCR

SEQ ID NO: 979 - protein, 36 aa, Artificial Sequence
  Description of Artificial Sequence: Synthetic polypeptide
TCTPCFTTDHQTARKCDDCCGGAGRGKCYGPQCLCR

SEQ ID NO: 980 - protein, 36 aa, Artificial Sequence
  Description of Artificial Sequence: Synthetic polypeptide
TCTPCFTTDHQTARACDDCCGGAGRGKCYGPQCLCR

SEQ ID NO: 981 - protein, 36 aa, Artificial Sequence
  Description of Artificial Sequence: Synthetic polypeptide
TCTPCFTTDHQTARRCDDCCGGAGRGKCYGPQCLCR

SEQ ID NO: 982 - protein, 36 aa, Artificial Sequence
  Description of Artificial Sequence: Synthetic polypeptide
TCTPCFTTDHQTARKCDDCCGGRGRGKCYGPQCLCR

SEQ ID NO: 983 - protein, 36 aa, Artificial Sequence
  Description of Artificial Sequence: Synthetic polypeptide
TCTPCFTTDHQTARACDDCCGGRGRGKCYGPQCLCR

SEQ ID NO: 984 - protein, 36 aa, Artificial Sequence
  Description of Artificial Sequence: Synthetic polypeptide
TCTPCFTTDHQTARRCDDCCGGRGRGKCYGPQCLCR

SEQ ID NO: 985 - protein, 36 aa, Artificial Sequence
  Description of Artificial Sequence: Synthetic polypeptide
TCTPCFTTDHQTARKCDDCCGGKGRGACYGPQCLCR

SEQ ID NO: 986 - protein, 36 aa, Artificial Sequence
  Description of Artificial Sequence: Synthetic polypeptide
TCTPCFTTDHQTARACDDCCGGKGRGACYGPQCLCR

SEQ ID NO: 987 - protein, 36 aa, Artificial Sequence
  Description of Artificial Sequence: Synthetic polypeptide
TCTPCFTTDHQTARRCDDCCGGKGRGACYGPQCLCR

SEQ ID NO: 988 - protein, 36 aa, Artificial Sequence
  Description of Artificial Sequence: Synthetic polypeptide
TCTPCFTTDHQTARKCDDCCGGAGRGACYGPQCLCR

SEQ ID NO: 989 - protein, 36 aa, Artificial Sequence
  Description of Artificial Sequence: Synthetic polypeptide
TCTPCFTTDHQTARACDDCCGGAGRGACYGPQCLCR

SEQ ID NO: 990 - protein, 36 aa, Artificial Sequence
  Description of Artificial Sequence: Synthetic polypeptide
TCTPCFTTDHQTARRCDDCCGGAGRGACYGPQCLCR

SEQ ID NO: 991 - protein, 36 aa, Artificial Sequence
  Description of Artificial Sequence: Synthetic polypeptide
TCTPCFTTDHQTARKCDDCCGGRGRGACYGPQCLCR

SEQ ID NO: 992 - protein, 36 aa, Artificial Sequence
  Description of Artificial Sequence: Synthetic polypeptide
TCTPCFTTDHQTARACDDCCGGRGRGACYGPQCLCR

SEQ ID NO: 993 - protein, 36 aa, Artificial Sequence
  Description of Artificial Sequence: Synthetic polypeptide
TCTPCFTTDHQTARRCDDCCGGRGRGACYGPQCLCR

SEQ ID NO: 994 - protein, 36 aa, Artificial Sequence
  Description of Artificial Sequence: Synthetic polypeptide
TCTPCFTTDHQTARKCDDCCGGKGRGRCYGPQCLCR

SEQ ID NO: 995 - protein, 36 aa, Artificial Sequence
  Description of Artificial Sequence: Synthetic polypeptide
TCTPCFTTDHQTARACDDCCGGKGRGRCYGPQCLCR

SEQ ID NO: 996 - protein, 36 aa, Artificial Sequence
  Description of Artificial Sequence: Synthetic polypeptide
TCTPCFTTDHQTARRCDDCCGGKGRGRCYGPQCLCR

SEQ ID NO: 997 - protein, 36 aa, Artificial Sequence
  Description of Artificial Sequence: Synthetic polypeptide
TCTPCFTTDHQTARKCDDCCGGAGRGRCYGPQCLCR

SEQ ID NO: 998 - protein, 36 aa, Artificial Sequence
  Description of Artificial Sequence: Synthetic polypeptide
TCTPCFTTDHQTARACDDCCGGAGRGRCYGPQCLCR

SEQ ID NO: 999 - protein, 36 aa, Artificial Sequence
  Description of Artificial Sequence: Synthetic polypeptide
TCTPCFTTDHQTARRCDDCCGGAGRGRCYGPQCLCR

SEQ ID NO: 1000 - protein, 36 aa, Artificial Sequence
  Description of Artificial Sequence: Synthetic polypeptide
TCTPCFTTDHQTARKCDDCCGGRGRGRCYGPQCLCR

SEQ ID NO: 1001 - protein, 36 aa, Artificial Sequence
  Description of Artificial Sequence: Synthetic polypeptide
TCTPCFTTDHQTARACDDCCGGRGRGRCYGPQCLCR

SEQ ID NO: 1002 - protein, 36 aa, Artificial Sequence
  Description of Artificial Sequence: Synthetic polypeptide
TCTPCFTTDHQTARRCDDCCGGRGRGRCYGPQCLCR

SEQ ID NO: 1003 - protein, 36 aa, Artificial Sequence
  Description of Artificial Sequence: Synthetic polypeptide
KCTPCFTTDHQTARRCDDCCGGRGRGRCYGPQCLCR

SEQ ID NO: 1004 - protein, 36 aa, Artificial Sequence
  Description of Artificial Sequence: Synthetic polypeptide
  MOD_RES (15)..(15): Citrulline
  MOD_RES (23)..(23): Citrulline
TCTPCFTTDHQTARXCDDCCGGXGRGKCYGPQCLCR

SEQ ID NO: 1005 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
TCTPCFTTDHQTARXCDDCCGGXGRGXCYGPQCLCR

SEQ ID NO: 1006 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
KCTPCFTTDHQTARXCDDCCGGXGRGXCYGPQCLCR

SEQ ID NO: 1007 - protein, 36 aa, Artificial Sequence
  Description of Artificial Sequence: Synthetic polypeptide
VCVPCFTTDHQVARKCDDCCGGKGRGKCYGPQCLCR

SEQ ID NO: 1008 - protein, 36 aa, Artificial Sequence
  Description of Artificial Sequence: Synthetic polypeptide
VCVPCFTTDHQVARACDDCCGGKGRGKCYGPQCLCR

SEQ ID NO: 1009 - protein, 36 aa, Artificial Sequence
  Description of Artificial Sequence: Synthetic polypeptide
VCVPCFTTDHQVARRCDDCCGGKGRGKCYGPQCLCR

SEQ ID NO: 1010 - protein, 36 aa, Artificial Sequence
  Description of Artificial Sequence: Synthetic polypeptide
VCVPCFTTDHQVARKCDDCCGGAGRGKCYGPQCLCR

SEQ ID NO: 1011 - protein, 36 aa, Artificial Sequence
  Description of Artificial Sequence: Synthetic polypeptide
VCVPCFTTDHQVARACDDCCGGAGRGKCYGPQCLCR

SEQ ID NO: 1012 - protein, 36 aa, Artificial Sequence
  Description of Artificial Sequence: Synthetic polypeptide
VCVPCFTTDHQVARRCDDCCGGAGRGKCYGPQCLCR

SEQ ID NO: 1013 - protein, 36 aa, Artificial Sequence
  Description of Artificial Sequence: Synthetic polypeptide
VCVPCFTTDHQVARKCDDCCGGRGRGKCYGPQCLCR

SEQ ID NO: 1014 - protein, 36 aa, Artificial Sequence
  Description of Artificial Sequence: Synthetic polypeptide
VCVPCFTTDHQVARACDDCCGGRGRGKCYGPQCLCR

SEQ ID NO: 1015 - protein, 36 aa, Artificial Sequence
  Description of Artificial Sequence: Synthetic polypeptide
VCVPCFTTDHQVARRCDDCCGGRGRGKCYGPQCLCR

SEQ ID NO: 1016 - protein, 36 aa, Artificial Sequence
  Description of Artificial Sequence: Synthetic polypeptide
VCVPCFTTDHQVARKCDDCCGGKGRGACYGPQCLCR

SEQ ID NO: 1017 - protein, 36 aa, Artificial Sequence
  Description of Artificial Sequence: Synthetic polypeptide
VCVPCFTTDHQVARACDDCCGGKGRGACYGPQCLCR

SEQ ID NO: 1018 - protein, 36 aa, Artificial Sequence
  Description of Artificial Sequence: Synthetic polypeptide
VCVPCFTTDHQVARRCDDCCGGKGRGACYGPQCLCR

SEQ ID NO: 1019 - protein, 36 aa, Artificial Sequence
  Description of Artificial Sequence: Synthetic polypeptide
VCVPCFTTDHQVARKCDDCCGGAGRGACYGPQCLCR

SEQ ID NO: 1020 - protein, 36 aa, Artificial Sequence
  Description of Artificial Sequence: Synthetic polypeptide
VCVPCFTTDHQVARACDDCCGGAGRGACYGPQCLCR

SEQ ID NO: 1021 - protein, 36 aa, Artificial Sequence
  Description of Artificial Sequence: Synthetic polypeptide
VCVPCFTTDHQVARRCDDCCGGAGRGACYGPQCLCR

SEQ ID NO: 1022 - protein, 36 aa, Artificial Sequence
  Description of Artificial Sequence: Synthetic polypeptide
VCVPCFTTDHQVARKCDDCCGGRGRGACYGPQCLCR

SEQ ID NO: 1023 - protein, 36 aa, Artificial Sequence
  Description of Artificial Sequence: Synthetic polypeptide
VCVPCFTTDHQVARACDDCCGGRGRGACYGPQCLCR

SEQ ID NO: 1024 - protein, 36 aa, Artificial Sequence
  Description of Artificial Sequence: Synthetic polypeptide
VCVPCFTTDHQVARRCDDCCGGRGRGACYGPQCLCR

SEQ ID NO: 1025 - protein, 36 aa, Artificial Sequence
  Description of Artificial Sequence: Synthetic polypeptide
VCVPCFTTDHQVARKCDDCCGGKGRGRCYGPQCLCR

SEQ ID NO: 1026 - protein, 36 aa, Artificial Sequence
  Description of Artificial Sequence: Synthetic polypeptide
VCVPCFTTDHQVARACDDCCGGKGRGRCYGPQCLCR

SEQ ID NO: 1027 - protein, 36 aa, Artificial Sequence
  Description of Artificial Sequence: Synthetic polypeptide
VCVPCFTTDHQVARRCDDCCGGKGRGRCYGPQCLCR

SEQ ID NO: 1028 - protein, 36 aa, Artificial Sequence
  Description of Artificial Sequence: Synthetic polypeptide
VCVPCFTTDHQVARKCDDCCGGAGRGRCYGPQCLCR

SEQ ID NO: 1029 - protein, 36 aa, Artificial Sequence
  Description of Artificial Sequence: Synthetic polypeptide
VCVPCFTTDHQVARACDDCCGGAGRGRCYGPQCLCR

SEQ ID NO: 1030 - protein, 36 aa, Artificial Sequence
  Description of Artificial Sequence: Synthetic polypeptide
VCVPCFTTDHQVARRCDDCCGGAGRGRCYGPQCLCR

SEQ ID NO: 1031 - protein, 36 aa, Artificial Sequence
  Description of Artificial Sequence: Synthetic polypeptide
VCVPCFTTDHQVARKCDDCCGGRGRGRCYGPQCLCR

SEQ ID NO: 1032 - protein, 36 aa, Artificial Sequence
  Description of Artificial Sequence: Synthetic polypeptide
VCVPCFTTDHQVARACDDCCGGRGRGRCYGPQCLCR

SEQ ID NO: 1033 - protein, 36 aa, Artificial Sequence
  Description of Artificial Sequence: Synthetic polypeptide
VCVPCFTTDHQVARRCDDCCGGRGRGRCYGPQCLCR

SEQ ID NO: 1034 - protein, 36 aa, Artificial Sequence
  Description of Artificial Sequence: Synthetic polypeptide
KCVPCFTTDHQVARRCDDCCGGRGRGRCYGPQCLCR

SEQ ID NO: 1035 - protein, 36 aa, Artificial Sequence
  Description of Artificial Sequence: Synthetic polypeptide
  MOD_RES (15)..(15): Citrulline
  MOD_RES (23)..(23): Citrulline
VCVPCFTTDHQVARXCDDCCGGXGRGKCYGPQCLCR

SEQ ID NO: 1036 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
VCVPCFTTDHQVARXCDDCCGGXGRGXCYGPQCLCR

SEQ ID NO: 1037 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
KCVPCFTTDHQVARXCDDCCGGXGRGXCYGPQCLCR

SEQ ID NO: 1038 - protein, 36 aa, Artificial Sequence
  Description of Artificial Sequence: Synthetic polypeptide
LCLPCFTTDHQLARKCDDCCGGKGRGKCYGPQCLCR

SEQ ID NO: 1039 - protein, 36 aa, Artificial Sequence
  Description of Artificial Sequence: Synthetic polypeptide
LCLPCFTTDHQLARACDDCCGGKGRGKCYGPQCLCR

SEQ ID NO: 1040 - protein, 36 aa, Artificial Sequence
  Description of Artificial Sequence: Synthetic polypeptide
LCLPCFTTDHQLARRCDDCCGGKGRGKCYGPQCLCR

SEQ ID NO: 1041 - protein, 36 aa, Artificial Sequence
  Description of Artificial Sequence: Synthetic polypeptide
LCLPCFTTDHQLARKCDDCCGGAGRGKCYGPQCLCR

SEQ ID NO: 1042 - protein, 36 aa, Artificial Sequence
  Description of Artificial Sequence: Synthetic polypeptide
LCLPCFTTDHQLARACDDCCGGAGRGKCYGPQCLCR

SEQ ID NO: 1043 - protein, 36 aa, Artificial Sequence
  Description of Artificial Sequence: Synthetic polypeptide
LCLPCFTTDHQLARRCDDCCGGAGRGKCYGPQCLCR

SEQ ID NO: 1044 - protein, 36 aa, Artificial Sequence
  Description of Artificial Sequence: Synthetic polypeptide
LCLPCFTTDHQLARKCDDCCGGRGRGKCYGPQCLCR

SEQ ID NO: 1045 - protein, 36 aa, Artificial Sequence
  Description of Artificial Sequence: Synthetic polypeptide
LCLPCFTTDHQLARACDDCCGGRGRGKCYGPQCLCR

SEQ ID NO: 1046 - protein, 36 aa, Artificial Sequence
  Description of Artificial Sequence: Synthetic polypeptide
LCLPCFTTDHQLARRCDDCCGGRGRGKCYGPQCLCR

SEQ ID NO: 1047 - protein, 36 aa, Artificial Sequence
  Description of Artificial Sequence: Synthetic polypeptide
LCLPCFTTDHQLARKCDDCCGGKGRGACYGPQCLCR

SEQ ID NO: 1048 - protein, 36 aa, Artificial Sequence
  Description of Artificial Sequence: Synthetic polypeptide
LCLPCFTTDHQLARACDDCCGGKGRGACYGPQCLCR

SEQ ID NO: 1049 - protein, 36 aa, Artificial Sequence
  Description of Artificial Sequence: Synthetic polypeptide
LCLPCFTTDHQLARRCDDCCGGKGRGACYGPQCLCR

SEQ ID NO: 1050 - protein, 36 aa, Artificial Sequence
  Description of Artificial Sequence: Synthetic polypeptide
LCLPCFTTDHQLARKCDDCCGGAGRGACYGPQCLCR

SEQ ID NO: 1051 - protein, 36 aa, Artificial Sequence
  Description of Artificial Sequence: Synthetic polypeptide
LCLPCFTTDHQLARACDDCCGGAGRGACYGPQCLCR

SEQ ID NO: 1052 - protein, 36 aa, Artificial Sequence
  Description of Artificial Sequence: Synthetic polypeptide
LCLPCFTTDHQLARRCDDCCGGAGRGACYGPQCLCR

SEQ ID NO: 1053 - protein, 36 aa, Artificial Sequence
  Description of Artificial Sequence: Synthetic polypeptide
LCLPCFTTDHQLARKCDDCCGGRGRGACYGPQCLCR

SEQ ID NO: 1054 - protein, 36 aa, Artificial Sequence
  Description of Artificial Sequence: Synthetic polypeptide
LCLPCFTTDHQLARACDDCCGGRGRGACYGPQCLCR

SEQ ID NO: 1055 - protein, 36 aa, Artificial Sequence
  Description of Artificial Sequence: Synthetic polypeptide
LCLPCFTTDHQLARRCDDCCGGRGRGACYGPQCLCR

SEQ ID NO: 1056 - protein, 36 aa, Artificial Sequence
  Description of Artificial Sequence: Synthetic polypeptide
LCLPCFTTDHQLARKCDDCCGGKGRGRCYGPQCLCR

SEQ ID NO: 1057 - protein, 36 aa, Artificial Sequence
  Description of Artificial Sequence: Synthetic polypeptide
LCLPCFTTDHQLARACDDCCGGKGRGRCYGPQCLCR

SEQ ID NO: 1058 - protein, 36 aa, Artificial Sequence
  Description of Artificial Sequence: Synthetic polypeptide
LCLPCFTTDHQLARRCDDCCGGKGRGRCYGPQCLCR

SEQ ID NO: 1059 - protein, 36 aa, Artificial Sequence
  Description of Artificial Sequence: Synthetic polypeptide
LCLPCFTTDHQLARKCDDCCGGAGRGRCYGPQCLCR

SEQ ID NO: 1060 - protein, 36 aa, Artificial Sequence
  Description of Artificial Sequence: Synthetic polypeptide
LCLPCFTTDHQLARACDDCCGGAGRGRCYGPQCLCR

SEQ ID NO: 1061 - protein, 36 aa, Artificial Sequence
  Description of Artificial Sequence: Synthetic polypeptide
LCLPCFTTDHQLARRCDDCCGGAGRGRCYGPQCLCR

SEQ ID NO: 1062 - protein, 36 aa, Artificial Sequence
  Description of Artificial Sequence: Synthetic polypeptide
LCLPCFTTDHQLARKCDDCCGGRGRGRCYGPQCLCR

SEQ ID NO: 1063 - protein, 36 aa, Artificial Sequence
  Description of Artificial Sequence: Synthetic polypeptide
LCLPCFTTDHQLARACDDCCGGRGRGRCYGPQCLCR

SEQ ID NO: 1064 - protein, 36 aa, Artificial Sequence
  Description of Artificial Sequence: Synthetic polypeptide
LCLPCFTTDHQLARRCDDCCGGRGRGRCYGPQCLCR

SEQ ID NO: 1065 - protein, 36 aa, Artificial Sequence
  Description of Artificial Sequence: Synthetic polypeptide
KCLPCFTTDHQLARRCDDCCGGRGRGRCYGPQCLCR

SEQ ID NO: 1066 - protein, 36 aa, Artificial Sequence
  Description of Artificial Sequence: Synthetic polypeptide
  MOD_RES (15)..(15): Citrulline
  MOD_RES (23)..(23): Citrulline
LCLPCFTTDHQLARXCDDCCGGXGRGKCYGPQCLCR

SEQ ID NO: 1067 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
LCLPCFTTDHQLARXCDDCCGGXGRGXCYGPQCLCR

SEQ ID NO: 1068 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
KCLPCFTTDHQLARXCDDCCGGXGRGXCYGPQCLCR

SEQ ID NO: 1069 - protein, 36 aa, Artificial Sequence
  Description of Artificial Sequence: Synthetic polypeptide
SCSPCFTTDHQSARKCDDCCGGKGRGKCYGPQCLCR

SEQ ID NO: 1070 - protein, 36 aa, Artificial Sequence
  Description of Artificial Sequence: Synthetic polypeptide
SCSPCFTTDHQSARACDDCCGGKGRGKCYGPQCLCR

SEQ ID NO: 1071 - protein, 36 aa, Artificial Sequence
  Description of Artificial Sequence: Synthetic polypeptide
SCSPCFTTDHQSARRCDDCCGGKGRGKCYGPQCLCR

SEQ ID NO: 1072 - protein, 36 aa, Artificial Sequence
  Description of Artificial Sequence: Synthetic polypeptide
SCSPCFTTDHQSARKCDDCCGGAGRGKCYGPQCLCR

SEQ ID NO: 1073 - protein, 36 aa, Artificial Sequence
  Description of Artificial Sequence: Synthetic polypeptide
SCSPCFTTDHQSARACDDCCGGAGRGKCYGPQCLCR

SEQ ID NO: 1074 - protein, 36 aa, Artificial Sequence
  Description of Artificial Sequence: Synthetic polypeptide
SCSPCFTTDHQSARRCDDCCGGAGRGKCYGPQCLCR

SEQ ID NO: 1075 - protein, 36 aa, Artificial Sequence
  Description of Artificial Sequence: Synthetic polypeptide
SCSPCFTTDHQSARKCDDCCGGRGRGKCYGPQCLCR

SEQ ID NO: 1076 - protein, 36 aa, Artificial Sequence
  Description of Artificial Sequence: Synthetic polypeptide
SCSPCFTTDHQSARACDDCCGGRGRGKCYGPQCLCR

SEQ ID NO: 1077 - protein, 36 aa, Artificial Sequence
  Description of Artificial Sequence: Synthetic polypeptide
SCSPCFTTDHQSARRCDDCCGGRGRGKCYGPQCLCR

SEQ ID NO: 1078 - protein, 36 aa, Artificial Sequence
  Description of Artificial Sequence: Synthetic polypeptide
SCSPCFTTDHQSARKCDDCCGGKGRGACYGPQCLCR

SEQ ID NO: 1079 - protein, 36 aa, Artificial Sequence
  Description of Artificial Sequence: Synthetic polypeptide
SCSPCFTTDHQSARACDDCCGGKGRGACYGPQCLCR

SEQ ID NO: 1080 - protein, 36 aa, Artificial Sequence
  Description of Artificial Sequence: Synthetic polypeptide
SCSPCFTTDHQSARRCDDCCGGKGRGACYGPQCLCR

SEQ ID NO: 1081 - protein, 36 aa, Artificial Sequence
  Description of Artificial Sequence: Synthetic polypeptide
SCSPCFTTDHQSARKCDDCCGGAGRGACYGPQCLCR

SEQ ID NO: 1082 - protein, 36 aa, Artificial Sequence
  Description of Artificial Sequence: Synthetic polypeptide
SCSPCFTTDHQSARACDDCCGGAGRGACYGPQCLCR

SEQ ID NO: 1083 - protein, 36 aa, Artificial Sequence
  Description of Artificial Sequence: Synthetic polypeptide
SCSPCFTTDHQSARRCDDCCGGAGRGACYGPQCLCR

SEQ ID NO: 1084 - protein, 36 aa, Artificial Sequence
  Description of Artificial Sequence: Synthetic polypeptide
SCSPCFTTDHQSARKCDDCCGGRGRGACYGPQCLCR

SEQ ID NO: 1085 - protein, 36 aa, Artificial Sequence
  Description of Artificial Sequence: Synthetic polypeptide
SCSPCFTTDHQSARACDDCCGGRGRGACYGPQCLCR

SEQ ID NO: 1086 - protein, 36 aa, Artificial Sequence
  Description of Artificial Sequence: Synthetic polypeptide
SCSPCFTTDHQSARRCDDCCGGRGRGACYGPQCLCR

SEQ ID NO: 1087 - protein, 36 aa, Artificial Sequence
  Description of Artificial Sequence: Synthetic polypeptide
SCSPCFTTDHQSARKCDDCCGGKGRGRCYGPQCLCR

SEQ ID NO: 1088 - protein, 36 aa, Artificial Sequence
  Description of Artificial Sequence: Synthetic polypeptide
SCSPCFTTDHQSARACDDCCGGKGRGRCYGPQCLCR

SEQ ID NO: 1089 - protein, 36 aa, Artificial Sequence
  Description of Artificial Sequence: Synthetic polypeptide
SCSPCFTTDHQSARRCDDCCGGKGRGRCYGPQCLCR

SEQ ID NO: 1090 - protein, 36 aa, Artificial Sequence
  Description of Artificial Sequence: Synthetic polypeptide
SCSPCFTTDHQSARKCDDCCGGAGRGRCYGPQCLCR

SEQ ID NO: 1091 - protein, 36 aa, Artificial Sequence
  Description of Artificial Sequence: Synthetic polypeptide
SCSPCFTTDHQSARACDDCCGGAGRGRCYGPQCLCR

SEQ ID NO: 1092 - protein, 36 aa, Artificial Sequence
  Description of Artificial Sequence: Synthetic polypeptide
SCSPCFTTDHQSARRCDDCCGGAGRGRCYGPQCLCR

SEQ ID NO: 1093 - protein, 36 aa, Artificial Sequence
  Description of Artificial Sequence: Synthetic polypeptide
SCSPCFTTDHQSARKCDDCCGGRGRGRCYGPQCLCR

SEQ ID NO: 1094 - protein, 36 aa, Artificial Sequence
  Description of Artificial Sequence: Synthetic polypeptide
SCSPCFTTDHQSARACDDCCGGRGRGRCYGPQCLCR

SEQ ID NO: 1095 - protein, 36 aa, Artificial Sequence
  Description of Artificial Sequence: Synthetic polypeptide
SCSPCFTTDHQSARRCDDCCGGRGRGRCYGPQCLCR

SEQ ID NO: 1096 - protein, 36 aa, Artificial Sequence
  Description of Artificial Sequence: Synthetic polypeptide
KCSPCFTTDHQSARRCDDCCGGRGRGRCYGPQCLCR

SEQ ID NO: 1097 - protein, 36 aa, Artificial Sequence
  Description of Artificial Sequence: Synthetic polypeptide
  MOD_RES (15)..(15): Citrulline
  MOD_RES (23)..(23): Citrulline
SCSPCFTTDHQSARXCDDCCGGXGRGKCYGPQCLCR

SEQ ID NO: 1098 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
SCSPCFTTDHQSARXCDDCCGGXGRGXCYGPQCLCR

SEQ ID NO: 1099 - protein, 36 aa, Artificial Sequence
  Description of Artificial Sequence: Synthetic polypeptide
  MOD_RES (15)..(15): Citrulline
  MOD_RES (23)..(23): Citrulline
  MOD_RES (27)..(27): Citrulline
KCSPCFTTDHQSARXCDDCCGGXGRGXCYGPQCLCR

SEQ ID NO: 1100 - protein, 36 aa, Artificial Sequence
  Description of Artificial Sequence: Synthetic polypeptide
MCMPCFTTDPNMARKCRDCCGGNGKCFGPQCLCNRG

SEQ ID NO: 1101 - protein, 36 aa, Artificial Sequence
  Description of Artificial Sequence: Synthetic polypeptide
MCMPCFTTDHNMAKKCRDCCGGNGKCFGYQCLCNRG

SEQ ID NO: 1102 - protein, 36 aa, Artificial Sequence
  Description of Artificial Sequence: Synthetic polypeptide
MCMPCFTTDHQTARRCRDCCGGRGRKCFGQCLCGYD

SEQ ID NO: 1103 - protein, 36 aa, Artificial Sequence
  Description of Artificial Sequence: Synthetic polypeptide
ACGPCFTTDPQMAEKCSDCCGGIGTCYGPQCLCNRL

SEQ ID NO: 1104 - protein, 34 aa, Artificial Sequence
  Description of Artificial Sequence: Synthetic polypeptide
MCMPCFTTRPNMAQQCRDCCRGRGKCFGPQCLCG

SEQ ID NO: 1105 - protein, 36 aa, Artificial Sequence
  Description of Artificial Sequence: Synthetic polypeptide
MCMPCFTTRPNMAQQCRDCCRGRGKCFGPQCLCGYD

SEQ ID NO: 1106 - protein, 34 aa, Artificial Sequence
  Description of Artificial Sequence: Synthetic polypeptide
MCMPCFTTNLNMEQECRDCCGGTGRCFGPQCLCG

SEQ ID NO: 1107 - protein, 36 aa, Artificial Sequence
  Description of Artificial Sequence: Synthetic polypeptide
GCMPCFTTDRYMARKCKECCRGYGNCFGPQCLCNRG

SEQ ID NO: 1108 - protein, 36 aa, Artificial Sequence
  Description of Artificial Sequence: Synthetic polypeptide
GCGPCFTTDANMARKCRECCGGNGKCFGPQCLCNRE

SEQ ID NO: 1109 - protein, 36 aa, Artificial Sequence
  Description of Artificial Sequence: Synthetic polypeptide
GCGPCFTTDANMARKCRECCGGIGKCFGPQCLCNRI

SEQ ID NO: 1110 - protein, 34 aa, Artificial Sequence
  Description of Artificial Sequence: Synthetic polypeptide
MCMPCFTTRPDMAQQCRACCKGRGKCFGPQCLCG

SEQ ID NO: 1111 - protein, 34 aa, Artificial Sequence
  Description of Artificial Sequence: Synthetic polypeptide
MCIPCFTTNPNMAAKCNACCGSRRGSCRGPQCIC

SEQ ID NO: 1112 - protein, 35 aa, Artificial Sequence [sequence omitted]

SEQ ID NO: 1113 - protein, 34 aa, Artificial Sequence
  Description of Artificial Sequence: Synthetic polypeptide
CGPCFTTDPYTESKCATCCGGRGKCVGPQCLCNR

SEQ ID NO: 1114 - protein, 35 aa, Artificial Sequence
  Description of Artificial Sequence: Synthetic polypeptide
RCGPCFTTDPQTQAKCSECCGRKGGVCKGPQCICG

SEQ ID NO: 1115 - protein, 35 aa, Artificial Sequence
  Description of Artificial Sequence: Synthetic polypeptide
CGPCFTKDPETEKKCATCCGGIGRCFGPQCLCNRG

SEQ ID NO: 1116 - protein, 36 aa, Artificial Sequence
  Description of Artificial Sequence: Synthetic polypeptide
MCMPCFTTDHQMARRCDDCCGGRGRGKCWGPQCLCR

SEQ ID NO: 1117 - protein, 37 aa, Artificial Sequence
  Description of Artificial Sequence: Synthetic polypeptide
AMCMPCFTTDHNMAKKCRDCCGGNGKCFGPQCLCNRG

SEQ ID NO: 1118 - protein, 35 aa, Artificial Sequence
  Description of Artificial Sequence: Synthetic polypeptide
CGPCFTTDWESEKKCAECCGGIGRCFGPQCLCNRK

SEQ ID NO: 1119 - protein, 34 aa, Artificial Sequence
  Description of Artificial Sequence: Synthetic polypeptide
CGPCFTTDHQTEQKCAECCGGIGKCYGPQCLCRG

SEQ ID NO: 1120 - protein, 34 aa, Artificial Sequence
  Description of Artificial Sequence: Synthetic polypeptide
CGPCFTTDRQMEQKCAECCGGIGKCYGPQCLCRG

SEQ ID NO: 1121 - protein, 32 aa, Artificial Sequence
  Description of Artificial Sequence: Synthetic polypeptide
CGPCFTTDHQTEQKCAECCGGIGKCYGPQCLC

SEQ ID NO: 1122 - protein, 34 aa, Artificial Sequence
  Description of Artificial Sequence: Synthetic polypeptide
CMPCFTTDHQMARKCDDCCGGRGKCYGPQCLCRG

SEQ ID NO: 1123 - protein, 37 aa, Artificial Sequence
  Description of Artificial Sequence: Synthetic polypeptide
RCGPCFTTDPQTQAKCSECCGRKGGVCKGPQCICGIQ

SEQ ID NO: 1124 - protein, 35 aa, Artificial Sequence
  Description of Artificial Sequence: Synthetic polypeptide
RCPPCFTTNPNMEADCRKCCGGRGYCASYQCICPG

SEQ ID NO: 1125 - protein, 35 aa, Artificial Sequence
  Description of Artificial Sequence: Synthetic polypeptide
CGPCFTTDHNMARKCDECCGGKGRGKCFGPQCLCR

SEQ ID NO: 1126 - protein, 36 aa, Artificial Sequence
  Description of Artificial Sequence: Synthetic polypeptide
VCMPCFTTDQQMARKCSDCCGGKGRGKCYGPQCLCR

SEQ ID NO: 1127 - protein, 36 aa, Artificial Sequence
  Description of Artificial Sequence: Synthetic polypeptide
MCGPCFTTDANMARKCRECCGGIGKCFGPQCLCNRI

SEQ ID NO: 1128 - protein, 36 aa, Artificial Sequence
  Description of Artificial Sequence: Synthetic polypeptide
MCGPCFTTDANMAAACRECCGGIGKCFGPQCLCNRI

SEQ ID NO: 1129 - protein, 36 aa, Artificial Sequence
  Description of Artificial Sequence: Synthetic polypeptide
MCGPCFTTDANMARKCAECCGGIGKCFGPQCLCNRI

SEQ ID NO: 1130 - protein, 36 aa, Artificial Sequence
  Description of Artificial Sequence: Synthetic polypeptide
MCGPCFTTDANMARKCRECCGGIGACFGPQCLCNRI

SEQ ID NO: 1131 - protein, 36 aa, Artificial Sequence
  Description of Artificial Sequence: Synthetic polypeptide
MCGPCFTTDANMARKCRECCGGIGKCFGPQCLCNAI

SEQ ID NO: 1132 - protein, 35 aa, Artificial Sequence
  Description of Artificial Sequence: Synthetic polypeptide
CMPCFTTRPNMAQQCRDCCRGRGKCFGPQCLCGYD

SEQ ID NO: 1133 - protein, 36 aa, Artificial Sequence
  Description of Artificial Sequence: Synthetic polypeptide
MCMPCFTTNLNMEQECRDCCGGTGRCFGPQCLCGYD

SEQ ID NO: 1134 - protein, 35 aa, Artificial Sequence; identical to SEQ ID NO: 1132
  Description of Artificial Sequence: Synthetic polypeptide

SEQ ID NO: 1135 - protein, 210 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRDPALVHQRPAPPGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 1136 - protein, 217 aa, Artificial Sequence
  Description of Artificial Sequence: Synthetic polypeptide
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPP

SEQ ID NO: 1137 - protein, 210 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRDPALVHQRPAPPGGSGGGGSGGGSGGGGSLQNWVNVISDLKKIEDLIQSMHIDATLYTESDVHPSCKVTAMKCFLLELQVISLESGDASIHDTVENLIILANDSLSSNGNVTESGCKECEELEEKNIKEFLQSFVHIVQMFINTS

SEQ ID NO: 1138 - protein, 217 aa, Artificial Sequence
  Description of Artificial Sequence: Synthetic polypeptide
NWVNVISDLKKIEDLIQSMHIDATLYTESDVHPSCKVTAMKCFLLELQVISLESGDASIHDTVENLIILANDSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPP

SEQ ID NO: 1139 - protein, 2 aa, Artificial Sequence
  Description of Artificial Sequence: Synthetic peptide
VA

SEQ ID NO: 1140 - protein, 2 aa, Artificial Sequence
  Description of Artificial Sequence: Synthetic peptide
VK

SEQ ID NO: 1141 - protein, 2 aa, Artificial Sequence
  Description of Artificial Sequence: Synthetic peptide
VR

SEQ ID NO: 1142 - protein, 2 aa, Artificial Sequence
  Description of Artificial Sequence: Synthetic peptide
  MOD_RES (2)..(2): Citrulline
VX

SEQ ID NO: 1143 - protein, 2 aa, Artificial Sequence
  Description of Artificial Sequence: Synthetic peptide
FK

SEQ ID NO: 1144 - protein, 2 aa, Artificial Sequence
  Description of Artificial Sequence: Synthetic peptide
MK

SEQ ID NO: 1145 - protein, 2 aa, Artificial Sequence
  Description of Artificial Sequence: Synthetic peptide
NK

SEQ ID NO: 1146 - protein, 2 aa, Artificial Sequence
  Description of Artificial Sequence: Synthetic peptide
IP

SEQ ID NO: 1147 - protein, 2 aa, Artificial Sequence
  Description of Artificial Sequence: Synthetic peptide
GI

SEQ ID NO: 1148 - protein, 2 aa, Artificial Sequence
  Description of Artificial Sequence: Synthetic peptide
GL

SEQ ID NO: 1149 - protein, 2 aa, Artificial Sequence
  Description of Artificial Sequence: Synthetic peptide
GY

SEQ ID NO: 1150 - protein, 2 aa, Artificial Sequence
  Description of Artificial Sequence: Synthetic peptide
GM

SEQ ID NO: 1151 - protein, 2 aa, Artificial Sequence
  Description of Artificial Sequence: Synthetic peptide
MI

SEQ ID NO: 1152 - protein, 2 aa, Artificial Sequence
  Description of Artificial Sequence: Synthetic peptide
AI

SEQ ID NO: 1153 - protein, 2 aa, Artificial Sequence
  Description of Artificial Sequence: Synthetic peptide
PI

SEQ ID NO: 1154 - protein, 8 aa, Artificial Sequence
  Description of Artificial Sequence: Synthetic peptide
GPQGIAGQ

SEQ ID NO: 1155 - protein, 8 aa, Artificial Sequence
  Description of Artificial Sequence: Synthetic peptide
GPQGIFGQ

SEQ ID NO: 1156 - protein, 8 aa, Artificial Sequence
  Description of Artificial Sequence: Synthetic peptide
GPQGIWGQ

SEQ ID NO: 1157 - protein, 8 aa, Artificial Sequence
  Description of Artificial Sequence: Synthetic peptide
GPQGILGQ

SEQ ID NO: 1158 - protein, 8 aa, Artificial Sequence
  Description of Artificial Sequence: Synthetic peptide
GPQGIRGQ

SEQ ID NO: 1159 - protein, 8 aa, Artificial Sequence
  Description of Artificial Sequence: Synthetic peptide
GPLGIAGQ

SEQ ID NO: 1160 - protein, 8 aa, Artificial Sequence
  Description of Artificial Sequence: Synthetic peptide
GPMGIAGQ

SEQ ID NO: 1161 - protein, 8 aa, Artificial Sequence
  Description of Artificial Sequence: Synthetic peptide
GPYGIAGQ

SEQ ID NO: 1162 - protein, 12 aa, Artificial Sequence
  Description of Artificial Sequence: Synthetic peptide
DYKDDDDKIEGR

SEQ ID NO: 1163 - protein, 19 aa, Artificial Sequence
  Description of Artificial Sequence: Synthetic peptide
GGSGGGGSGGGSGGGGSLQ

SEQ ID NO: 1164 - protein, 17 aa, Artificial Sequence
  Description of Artificial Sequence: Synthetic peptide
GGSGGGGSGGGSGGGGS

SEQ ID NO: 1165 - protein, 26 aa, Artificial Sequence
  Description of Artificial Sequence: Synthetic peptide
SGGGSGGGGSGGGGSGGGGSGGGSLQ

SEQ ID NO: 1166 - protein, 24 aa, Artificial Sequence
  Description of Artificial Sequence: Synthetic peptide
SGGGSGGGGSGGGGSGGGGSGGGS

SEQ ID NO: 1167 - protein, 50 aa, Artificial Sequence
  Description of Artificial Sequence: Synthetic polypeptide
  MISC_FEATURE (1)..(50): This sequence may encompass 1-10 "Gly Gly Gly Gly Ser" repeating units
GGGGSGGGGSGGGGSGGGGSGGGGSGGGGSGGGGSGGGGSGGGGSGGGGS

SEQ ID NO: 1168 - protein, 2 aa, Artificial Sequence
  Description of Artificial Sequence: Synthetic peptide
GS

SEQ ID NO: 1169 - protein, 20 aa, Artificial Sequence
  Description of Artificial Sequence: Synthetic peptide
SGGSGGGGSGGGSGGGGSLQ

SEQ ID NO: 1170 - protein, 4 aa, Artificial Sequence
  Description of Artificial Sequence: Synthetic peptide
GGGS

SEQ ID NO: 1171 - protein, 8 aa, Artificial Sequence
  Description of Artificial Sequence: Synthetic peptide
GGGSGGGS

SEQ ID NO: 1172 - protein, 40 aa, Artificial Sequence
  Description of Artificial Sequence: Synthetic polypeptide
  MISC_FEATURE (1)..(40): This sequence may encompass 1-10 "Gly Gly Gly Ser" repeating units
GGGSGGGSGGGSGGGSGGGSGGGSGGGSGGGSGGGSGGGS

SEQ ID NO: 1173 - protein, 338 aa, Artificial Sequence
  Description of Artificial Sequence: Synthetic polypeptide
  MOD_RES (253)..(302): This region may encompass one of the following sequences: "VA" or "VK" or "VR" or "V-Cit" or "FK" or "MK" or "NK" or "IP" or "GI" or "GL" or "GY" or "GM" or "MI" or "AI" or "PI" or "GPQGIAGQ" or "GPQGIFGQ" or "GPQGIWGQ" or "GPQG
  MOD_RES (253)..(302): CONT. FROM ABOVE: ILGQ" or "GPQGIRGQ" or "GPLGIAGQ" or "GPMGIAGQ" or "GPYGIAGQ" or "DYKDDDDKIEGR" or "GGSGGG GSGGGSGGGGSLQ" or "GGSGGGGSGGGSGGGGS" or "SGGGSGGGGSG GGGSGGGGSGGGSLQ" or "SGGGSGGGGSGGGGSGGGGSGGGS" or "GG
  MOD_RES (253)..(302): CONT. FROM ABOVE: GGSGGGGSGGGGSGGGGSGGGGSGGGGSGGGGSGGGG SGGGGSGGGGS, this region may encompass 1-10 'Gly4Ser' repeating units" or "GS" or "SGGSGGGGSGGGSGGGGSLQ" or "GGGS" or "GGGSGGGS" or "GGGSGGGSGGGS
  MOD_RES (253)..(302): CONT. FROM ABOVE: GGGSGGGSGGGSGGGSGGGSGGGSGGGS, this region may encompass 1-10 'Gly3Ser' repeating units" or "GSVAGS" or "GGGGSVAGGGGS" or "GGGGSGGGGSVAGGGGSGGGG S" or "GGGGSGGGGSPLGLAGGGGGSGGGGS" or
  MOD_RES (253)..(302): CONT. FROM ABOVE: "AEAAAKEAAAKAVAAEAAAKEAAAKA"
  MOD_RES (253)..(302): Any amino acid or absent
  See specification as filed for detailed description of substitutions and preferred embodiments
MAPRRARGCRTLGLPALLLLLLLRPPATRGDYKDDDDKIEGRITCPPPMSVEHADIWVKSYSLYSRERYICNSGFKRKAGTSSLTECVLNKATNVAHWTTPSLKCIRDPALVHQRPAPPGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSXXXXXXXXXXXXXXXXXXXXXXXXXXXXXXXXXXXXXXXXXXXXXXXXXXMCMPCFTTDHQMARKCDDCCGGKGRGKCYGPQCLCR

SEQ ID NO: 1174 - protein, 345 aa, Artificial Sequence
  Description of Artificial Sequence: Synthetic polypeptide
  MOD_RES (260)..(309): This region may encompass one of the following sequences: "VA" or "VK" or "VR" or "V-Cit" or "FK" or "MK" or "NK" or "IP" or "GI" or "GL" or "GY" or "GM" or "MI" or "AI" or "PI" or "GPQGIAGQ" or "GPQGIFGQ" or "GPQGIWGQ" or "GPQG
  MOD_RES (260)..(309): CONT. FROM ABOVE: ILGQ" or "GPQGIRGQ" or "GPLGIAGQ" or "GPMGIAGQ" or "GPYGIAGQ" or "DYKDDDDKIEGR" or "GGSGGG GSGGGSGGGGSLQ" or "GGSGGGGSGGGSGGGGS" or "SGGGSGGGGSG GGGSGGGGSGGGSLQ" or "SGGGSGGGGSGGGGSGGGGSGGGS" or "GG
  MOD_RES (260)..(309): CONT. FROM ABOVE: GGSGGGGSGGGGSGGGGSGGGGSGGGGSGGGGSGGGG SGGGGSGGGGS, this region may encompass 1-10 'Gly4Ser' repeating units" or "GS" or "SGGSGGGGSGGGSGGGGSLQ" or "GGGS" or "GGGSGGGS" or "GGGSGGGSGGGS
  MOD_RES (260)..(309): CONT. FROM ABOVE: GGGSGGGSGGGSGGGSGGGSGGGSGGGS, this region may encompass 1-10 'Gly3Ser' repeating units" or "GSVAGS" or "GGGGSVAGGGGS" or "GGGGSGGGGSVAGGGGSGGGG S" or "GGGGSGGGGSPLGLAGGGGGSGGGGS" or
  MOD_RES (260)..(309): CONT. FROM ABOVE: "AEAAAKEAAAKAVAAEAAAKEAAAKA"
  MOD_RES (260)..(309): Any amino acid or absent
  See specification as filed for detailed description of substitutions and preferred embodiments
MAPRRARGCRTLGLPALLLLLLLRPPATRGDYKDDDDKIEGRNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPPXXXXXXXXXXXXXXXXXXXXXXXXXXXXXXXXXXXXXXXXXXXXXXXXXXMCMPCFTTDHQMARKCDDCCGGKGRGKCYGPQCLCR

SEQ ID NO: 1175 - skipped

SEQ ID NO: 1176 - protein, 77 aa, Homo sapiens
ITCPPPMSVEHADIWVKSYSLYSRERYICNSGFKRKAGTSSLTECVLNKATNVAHWTTPSLKCIRDPALVHQRPAPP

SEQ ID NO: 1177 - protein, 114 aa, Homo sapiens
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 1178 - protein, 114 aa, Artificial Sequence
  Description of Artificial Sequence: Synthetic polypeptide
NWVNVISDLKKIEDLIQSMHIDATLYTESDVHPSCKVTAMKCFLLELQVISLESGDASIHDTVENLIILANDSLSSNGNVTESGCKECEELEEKNIKEFLQSFVHIVQMFINTS

SEQ ID NO: 1179 - protein, 297 aa, Artificial Sequence
  Description of Artificial Sequence: Synthetic polypeptide
ITCPPPMSVEHADIWVKSYSLYSRERYICNSGFKRKAGTSSLTECVINKATNVAHWTTPSLKCIREPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1180 - RNA, 24 nt, Artificial Sequence
  Description of Artificial Sequence: Synthetic oligonucleotide
gacacacacacacacacacacuuu

SEQ ID NO: 1181 - RNA, 24 nt, Artificial Sequence
  Description of Artificial Sequence: Synthetic oligonucleotide
aaaguguguguguguguguguguc

SEQ ID NO: 1182 - RNA, 24 nt, Artificial Sequence
  Description of Artificial Sequence: Synthetic oligonucleotide
aacacacacacacacacacacuuu

SEQ ID NO: 1183 - RNA, 24 nt, Artificial Sequence
  Description of Artificial Sequence: Synthetic oligonucleotide
aaaguguguguguguguguguguu

SEQ ID NO: 1184 - RNA, 30 nt, Artificial Sequence
  Description of Artificial Sequence: Synthetic oligonucleotide
gacgacgacgacgacgacgacgacgacgac

SEQ ID NO: 1185 - RNA, 30 nt, Artificial Sequence
  Description of Artificial Sequence: Synthetic oligonucleotide
gucgucgucgucgucgucgucgucgucguc

SEQ ID NO: 1186 - RNA, 24 nt, Artificial Sequence
  Description of Artificial Sequence: Synthetic oligonucleotide
gacgcugacccugaaguucaucuu

SEQ ID NO: 1187 - RNA, 24 nt, Artificial Sequence
  Description of Artificial Sequence: Synthetic oligonucleotide
aagaugaacuucagggucagcguc

SEQ ID NO: 1188 - RNA, 78 nt, Artificial Sequence
  Description of Artificial Sequence: Synthetic oligonucleotide
gacgcuuaacaaauaaacaacaaaaaugagaaaaacaaucauaugucuguuuuuucuuugaucugguuguuaagcguc

SEQ ID NO: 1189 - RNA, 31 nt, Artificial Sequence
  Description of Artificial Sequence: Synthetic oligonucleotide
ggcaaaagcagggagacaaagacaaaaaggc

SEQ ID NO: 1190 - RNA, 31 nt, Artificial Sequence
  Description of Artificial Sequence: Synthetic oligonucleotide
gccuuuuugucuuugucucccugcuuuugcc

SEQ ID NO: 1191 - RNA, 31 nt, Artificial Sequence
  Description of Artificial Sequence: Synthetic oligonucleotide
gggagaaacaagggcggcaacaaccaacaaa

SEQ ID NO: 1192 - RNA, 20 nt, Artificial Sequence
  Description of Artificial Sequence: Synthetic oligonucleotide
aauuuuaccuuguuucuccc

SEQ ID NO: 1193 - RNA, 71 nt, Artificial Sequence
  Description of Artificial Sequence: Synthetic oligonucleotide
aguagaaacaaggguauuuuucuuuaauugucguacuccucacucagugagugaucuacccugcuuuugcu

SEQ ID NO: 1194 - RNA, 63 nt, Artificial Sequence
  Description of Artificial Sequence: Synthetic oligonucleotide
accaaacaaagauuuggugaaugacgagacuacacaucguaacucaccgauucucuguuuggu

SEQ ID NO: 1195 - RNA, 29 nt, Artificial Sequence
  Description of Artificial Sequence: Synthetic oligonucleotide
accagacaagaguuuaucucuuguuuggu

SEQ ID NO: 1196 - RNA, 34 nt, Artificial Sequence
  Description of Artificial Sequence: Synthetic oligonucleotide
gagcagaaacaaggcuucggccuuguuucugcuc

SEQ ID NO: 1197 - RNA, 56 nt, Artificial Sequence
  Description of Artificial Sequence: Synthetic oligonucleotide
gggacgcugacccagaagaucuacuagaaauaguagaucuucugggucagcguccc

SEQ ID NO: 1198 - RNA, 40 nt, Artificial Sequence
  Description of Artificial Sequence: Synthetic oligonucleotide
ggcuagcgaccucuguuugaucaaacagaggucgcaugcc

SEQ ID NO: 1199 - RNA, 71 nt, Artificial Sequence
  Description of Artificial Sequence: Synthetic oligonucleotide
gggaggacgaugcgguaccugacagcaucuugauaaugguccuacggagccguuccagacgacucgcccga

SEQ ID NO: 1200 - RNA, 93 nt, Artificial Sequence
  Description of Artificial Sequence: Synthetic oligonucleotide
ggcgcuccgaccuuagucucugugccgcuauaaugcacggauuuaaucgccguagaaaagcaugucaaagccggaaccguguagcacagcaga

SEQ ID NO: 1201 - RNA, 60 nt, Artificial Sequence
  Description of Artificial Sequence: Synthetic oligonucleotide
gggagguggacgaacugcccucagcuacuuucauguugcugacgcacagacgacucgcug

SEQ ID NO: 1202 - RNA, 40 nt, Artificial Sequence
  Description of Artificial Sequence: Synthetic oligonucleotide
gggagguggacgaacugcccuacgcacagacgacucgcug

SEQ ID NO: 1203 - RNA, 23 nt, Artificial Sequence
  Description of Artificial Sequence: Synthetic oligonucleotide
ggaugcgguaccugacagcaucc

SEQ ID NO: 1204 - RNA, 23 nt, Artificial Sequence
  Description of Artificial Sequence: Synthetic oligonucleotide
ggaugcugucagguaccgcaucc

SEQ ID NO: 1205 - RNA, 140 nt, Artificial Sequence
  Description of Artificial Sequence: Synthetic polynucleotide
ggcuauacugcggacuauuuggcaaaggaagcauugacacaugcgccaaauuugccugcucuaccaaggcaauaggaagaaccaucuugaaagagaauaucaaguacgaaguggccauuuuuguccauggaccaacuacc

SEQ ID NO: 1206 - RNA, 140 nt, Artificial Sequence
  Description of Artificial Sequence: Synthetic polynucleotide
gguaguugguccauggacaaaaauggccacuucguacuugauauucucuuucaagaugguucuuccuauugccuugguagagcaggcaaauuuggcgcaugugucaaugcuuccuuugccaaauaguccgcaguauagcc

SEQ ID NO: 1207 - protein, 13 aa, Artificial Sequence
  Description of Artificial Sequence: Synthetic peptide
GRKKRRQRRRPPQ

SEQ ID NO: 1208 - protein, 16 aa, Artificial Sequence
  Description of Artificial Sequence: Synthetic peptide
RQIKIWFQNRRMKWKK

SEQ ID NO: 1209 - protein, 18 aa, Artificial Sequence
  Description of Artificial Sequence: Synthetic peptide
LLIILRRRIRKQAHAHSK

SEQ ID NO: 1210 - protein, 27 aa, Artificial Sequence
  Description of Artificial Sequence: Synthetic peptide
GWTLNSAGYLLGKINLKALAALAKKIL

SEQ ID NO: 1211 - protein, 27 aa, Artificial Sequence
  Description of Artificial Sequence: Synthetic peptide
GALFLGFLGAAGSTMGAWSQPKKKRKV

SEQ ID NO: 1212 - protein, 21 aa, Artificial Sequence
  Description of Artificial Sequence: Synthetic peptide
KETWWETWWTEWSQPKKKRKV

SEQ ID NO: 1213 - protein, 18 aa, Artificial Sequence
  Description of Artificial Sequence: Synthetic peptide
KLALKLALKALKAALKLA

SEQ ID NO: 1214 - protein, 9 aa, Artificial Sequence
  Description of Artificial Sequence: Synthetic peptide
RRWWRRWRR

SEQ ID NO: 1215 - protein, 16 aa, Artificial Sequence
  Description of Artificial Sequence: Synthetic peptide
DVVRVWFCNRRQKGKR

SEQ ID NO: 1216 - protein, 27 aa, Artificial Sequence
  Description of Artificial Sequence: Synthetic peptide
KDCERRFSRSDQLKRHQRRHTGVKPFQ

SEQ ID NO: 1217 - protein, 16 aa, Artificial Sequence
  Description of Artificial Sequence: Synthetic peptide
RKKRRRESRKKRRRES

SEQ ID NO: 1218 - protein, 34 aa, Artificial Sequence
  Description of Artificial Sequence: Synthetic polypeptide
DAATATRGRSAASRPTERPRAPARSASRPRRPVE

SEQ ID NO: 1219 - protein, 7 aa, Artificial Sequence
  Description of Artificial Sequence: Synthetic peptide
KRKRWHW

SEQ ID NO: 1220 - protein, 12 aa, Artificial Sequence
  Description of Artificial Sequence: Synthetic peptide
AAVLLPVLLAAP

SEQ ID NO: 1221 - protein, 10 aa, Artificial Sequence
  Description of Artificial Sequence: Synthetic peptide
PIEVCMYREP

SEQ ID NO: 1222 - protein, 15 aa, Artificial Sequence
  Description of Artificial Sequence: Synthetic peptide
VTVLALGALAGVGVG

SEQ ID NO: 1223 - protein, 6 aa, Artificial Sequence
  Description of Artificial Sequence: Synthetic peptide
PFVYLI

SEQ ID NO: 1224 - protein, 12 aa, Artificial Sequence
  Description of Artificial Sequence: Synthetic peptide
PLIYLRLLRGQF

SEQ ID NO: 1225 - protein, 448 aa, Artificial Sequence
  Description of Artificial Sequence: Synthetic polypeptide
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1226 - protein, 216 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPPALTFCGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1227 - protein, 204 aa, Artificial Sequence
  Description of Artificial Sequence: Synthetic polypeptide
CPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 1228 - protein, 442 aa, Artificial Sequence
  Description of Artificial Sequence: Synthetic polypeptide
EVQLVQSGAEVKKPGESLRISCKGSGYSFSTYWISWVRQMPGKGLEWMGKIYPGDSYTNYSPSFQGQVTISADKSISTAYLQWSSLKASDTAMYYCARGYGIFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1229 - protein, 214 aa, Artificial Sequence
  Description of Artificial Sequence: Synthetic polypeptide
SYELTQPPSVSVSPGQTASITCSGDNIGDQYAHWYQQKPGQSPVLVIYQDKNRPSGIPERFSGSNSGNTATLTISGTQAMDEADYYCATYTGFGSLAVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1230 - protein, 322 aa, Artificial Sequence
  Description of Artificial Sequence: Synthetic polypeptide
  MOD_RES (21)..(89): This region may encompass one of the following sequences: "GSMCMPCFTTDHQMARKCDDCCGGKGRGKCYGPQCLCR" or "GSMCMPCFTTD HQMARRCDDCCGGRGRGKCYGPQCLCR" or "GSMCMPCFTTDHQMARRCDDCCG GRGRGRCYGPQCLCR" or "GSMCMPCFTTDHQMARKCDDCCGGRGRGRCYGPQC
  MOD_RES (21)..(89): CONT. FROM ABOVE: LCR" or "GSMCMPCFTTDHQMARRCDDCCGGKGRGRC YGPQCLCR" or "GSMCMPCFTTHHRMAENCDICCGGDGRGKCYGPQCLCR" or "GSMCMPCFTTDTQMQERCDRCCGGGGRGKCWGPQCLCI" or "GSMCMPCFTTDT QMQERCDRCCGGGGRGRCWGPQCLCI" or "GSMCMPCFTTEQRMAIICDDCCGGF
  MOD_RES (21)..(89): CONT. FROM ABOVE: GRGKCYGPQCLCR" or "GSMCMPCFTTEQRMAIICD DCCGGFGRGRCYGPQCLCR" or "GSICIPCFTTDHQIARRCDDCCGGRGRGKCYG PQCICR" or "GSICIPCFTTDHQIARRCDDCCGGRGRGRCYGPQCICR" or "G SMCMPCFTTDHRMAENCDICCGGDGRGKCYGPQCLCR" or "GSMCMPCFTTDHR
  MOD_RES (21)..(89): CONT. FROM ABOVE: MAENCDICCGGDGRGRCYGPQCLCR" or "GSMCMPC FTTEQRMAIICDDCCGGFGRGKCYGPQCLCI" or "GSMCMPCFTTEQRMAIICDD CCGGFGRGRCYGPQCLCI" or "GSICIPCFTTDHQIARRCDDCCGGRGRGKCYGP QCICI" or "GSICIPCFTTDHQIARRCDDCCGGRGRGRCYGPQCICI" or "G
  MOD_RES (21)..(89): CONT. FROM ABOVE: SMCMPCFTTDHRMAENCDICCGGDGRGKCYGPQCLCI" or "GSMCMPCFTTDHRMAENCDICCGGDGRGRCYGPQCLCI" or "GSMCMPCF TTDTQMQEKCDRCCGGGGRGRCWGPQCLCI" or "GSMCMPCFTTEQRMAIKCDDC CGGFGRGRCYGPQCLCR" or "GSICIPCFTTDHQIARKCDDCCGGRGRGRCYGP
  MOD_RES (21)..(89): CONT. FROM ABOVE: QCICR" or "GSMCMPCFTTDHRMAEKCDICCGGDGR GRCYGPQCLCR" or "GSMCMPCFTTDTQMQERCDRCCGGKGRGRCWGPQCLCI" or "GSMCMPCFTTEQRMAIICDDCCGGKGRGRCYGPQCLCR" or "GSICIPCFT TDHQIARRCDDCCGGKGRGRCYGPQCICR" or "GSMCMPCFTTDHRMAENCDIC
  MOD_RES (21)..(89): CONT. FROM ABOVE: CGGKGRGRCYGPQCLCR" or "GSMCMPCFTTHHRMA ENCDICCGGDGRGRCYGPQCLCR" or "GSMCMPCFTTDTQMQERCDRCCGGGGRG RCWGPQCLC" or "GSMCMPCFTTEQRMAIICDDCCGGFGRGRCYGPQCLC" or "GSICIPCFTTDHQIARRCDDCCGGRGRGRCYGPQCIC" or "GSMCMPCFTTDH
  MOD_RES (21)..(89): CONT. FROM ABOVE: RMAENCDICCGGDGRGRCYGPQCLC" or "GSMCMPC FTTDHQMARRCDDCCGGRGRGRCYGPQCLCI" or "GSACAPCFTTDHQAARRCDD CCGGRGRGKCYGPQCLCR" or "GSACAPCFTTDHQAARKCDDCCGGKGRGKCYGP QCLCR" or "GSMCMPCFTTHHRMAENCDICCGGDGRGKCYGPQCLCI" or "G
  MOD_RES (21)..(89): CONT. FROM ABOVE: SMCMPCFTTHHRMAENCDICCGGDGRGKCYGPQCLC" or "GSMCMPCFTTDHQMARRCDDCCGGRGRGRCYGPQCLC" or "GSMCMPCFTT HHQMAENCDICCGGDGRGKCYGPQCLCR" or "GSMCMPCFTTHHRMARNCDICCG GDGRGKCYGPQCLCR" or "GSMCMPCFTTHHRMAERCDICCGGDGRGKCYGPQC
  MOD_RES (21)..(89): CONT. FROM ABOVE: LCR" or "GSMCMPCFTTHHRMAENCDDCCGGDGRGK CYGPQCLCR" or "GSRCMPCFTTDHQMARRCDDCCGGRGRGKCYGPQCLCR" or "GSICIPCFTTDHQIARRCDDCCGGRGRGKCYGPQCLCR" or "GSMCLPCFTTD HQLARRCDDCCGGRGRGKCYGPQCLCR" or "GSMCMPCFTTEHQMARRCEECCG
  MOD_RES (21)..(89): CONT. FROM ABOVE: GRGRGKCYGPQCLCR" or "GSMCIPCFTTDHQMARR CEECCGGRGRGKCYGPQCLCR" or "GSICIPCFTTDHQMARRCDDCCGGRGDGKC YGPQCLCR" or "GSRCMPCFTTDHFMARFCDFCCGGRGRGKCYGPQCLCR" or "GSRCMPCFTTDHYMARYCDYCCGGRGRGKCYGPQCLCR" or "GSRCMPCFTTD
  MOD_RES (21)..(89): CONT. FROM ABOVE: HRMARRCDRCCGGRGRGKCYGPQCLCR" or "GSRCM PCFTTDHEMARECDECCGGRGRGKCYGPQCLCR" or "GSRCMPCFTTDHHMARHC DHCCGGRGRGKCYGPQCLCR" or "GSLCLPCFTTHHRLADQCDICCGGDGRGKCY GPQCLCR" or "GSICIPCFTTEHQIARRCEECCGGRGRGKCYGPQCLCR" or
  MOD_RES (21)..(89): CONT. FROM ABOVE: "GSMCMPCFTTIYRMAHECDECCGGRGRGKCYGPQCLC R" or "GSMCMPCFTTGYRMAEYCDICCGGRGRGKCYGPQCLCR" or "GSMCMP CFTTHRRMANTCDACCGGRSRGKCYGPQCLCR" or "GSHCMPCFTTDHQMIRRCD DCCGGGSYGKCDGPQCLCF" or "GSDCMPCFTTDHRMADHCDICCGGDDRGKCY
  MOD_RES (21)..(89): CONT. FROM ABOVE: GPQCLCR" or "GSMCMPCFTTDHEMERRCDDCCGIG GGGKCHGPQCLCG" or "GSMCMPCFTTSEQMFRRCDDCCGGWGDGKCNGPHCLCR " or "GSCGPCFTTDHQMEQKCAECCGGIGKCYGPQCLCNR" or "GSRCGPCFT TDPQTQAKCSECCGRKGGVCKGPQCICGIQY" or "GSMCMPCFTTDPNMAKKCR
  MOD_RES (21)..(89): CONT. FROM ABOVE: DCCGGNGKCFGPQCLCNR" or "GSMCMPCFTTDHNM AKKCNDCCGGYGKCFGPQCLCR" or "GSRCPPCFTTNPNMEADCRKCCGGRGYCA SYQCICPGG" or "GSMCMPCFTTDPNMANKCRDCCGGGKKCFGPQCLCNR" or "GSMKFLYGVILIALFLTVMTATLSEARCGPCFTTDPQTQAKCSECCGRKGGVCKG
  MOD_RES (21)..(89): CONT. FROM ABOVE: PQCICGIQY" or "GSMCMPCFTTRPDMAQQCRACCK GRGKCFGPQCLCGYD" or "GSMKFLYGIVFIALFLTVMTATLSDAMCMPCFTTDH NMAKKCRDCCGGNGKCFGPQCLCNRG" or "GSMCMPCFTTDHNMAKKCRDCCGGN GKCFGPQCLCNR" or "GSMKFLYGIVFITLFLTVMIATHTEAMCMPCFTTRPNM
  MOD_RES (21)..(89): CONT. FROM ABOVE: AQQCRDCCRGRGKCFGPQCLCGYD" or "GSMKFLYG IVFIALFLTVMIATHTEAMCMPCFTTRPNMAQQCRDCCRGRGKCFGPQCLCGYD" o r "GSRCKPCFTTDPQMSKKCADCCGGKGKGKCYGPQCLC" or "GSMKFLYGIVF ITLFLTVMIATHTEAAMCMPCFTTNLNMEQECRDCCGGTGRCFGPQCLCGYD" or
  MOD_RES (21)..(89): CONT. FROM ABOVE:  "GSRCSPCFTTDQQMTKKCYDCCGGKGKGKCYGPQCI CAPY" or "GSCGPCFTTDPYTESKCATCCGGRGKCVGPQCLCNRI" or "GSTE AMCMPCFTTDHNMAKKCRDCCGGNGKCFGYQCLCNRG" or "GSMKFLYGIVFIAL FLTVMFATQTDGCGPCFTTDANMARKCRECCGGIGKCFGPQCLCNRI" or "GSM
  MOD_RES (21)..(89): CONT. FROM ABOVE: KFLYGIVFIALFLTVMFATQTDGCGPCFTTDANMARKC RECCGGNGKCFGPQCLCNRE" or "GSMKFLYGTILIAFFLTVMIATHSEARCPPC FTTNPNMEADCRKCCGGRGYCASYQCICPGG" or "GSTEAMCMPCFTTRPDMAQQ CRDCCGGNGKCFGYQCLCNRG" or "GSMKFLYGIVFIALFLTVMIATLTEAMCM
  MOD_RES (21)..(89): CONT. FROM ABOVE: PCFTTRPDMAQQCRDCCGGNGKCFGYQCLCNRG" or "GSMKFLYGIVFIALFLTVMIATHTEAMCMPCFTTRPDMAQQCRDCCGGNGKCFGYQ CLCNRG" or "GSMKFLYGIILIALFLTVMIATHSEARCPNCFTTNPNAEADCKKC CGNRWGKCAGYQCVCPMK" or "GSMKFLYGIVFIALFLTGMIATHTEAMCMPCF
  MOD_RES (21)..(89): CONT. FROM ABOVE: TTRPDMAQQCRDCCGGNGKCFGYQCLCNRGRIVIMYT" or "GSMCMPCFTTRPGMAQQCRDCCGGNGKCFGYQCLCNR" or "GSMCIPCFT TNPNMAAKCNACCGSRRGSCRGPQCICR" or "GSMCIPCFTTNPNMAAKCNACCG SRRGSCRGPQCICN" or "GSMCIPCFTTNPNMAAKCNACCGGNGSCRGPQCICN
  MOD_RES (21)..(89): CONT. FROM ABOVE: " or "GSMCIPCFTTNPNMAAKCNACCGSRGRGSCRG PQCICN" or "GSMCIPCFTTNPNMAAKCNACCGSRGRGKCRGPQCICN" or "G SMCIPCFTTDHQMAAKCNACCGSRRGSCRGPQCICN" or "GSMCIPCFTTNHQMA AKCNACCGSRRGSCRGPQCICN" or "GSMCIPCFTTNPNMARKCNACCGSRGRG
  MOD_RES (21)..(89): CONT. FROM ABOVE: SCRGPQCICN" or "GSMCIPCFTTNPNMAAKCNACC GGKGRGSCRGPQCICN" or "GSMCIPCFTTNPNMAAKCNACCGSRRGSCFGPQCI CN" or "GSMCIPCFTTNPNMAAKCNACCGSRGRGKCFGPQCICN" or "GSMCI PCFTTNPNMAAKCNACCGSRGRGSCFGPQCICN" or "GSMCIPCFTTNPNMAAK
  MOD_RES (21)..(89): CONT. FROM ABOVE: CNACCGSRGRGSCYGPQCICN" or "GSMCIPCFTTN PNMAAKCDACCGSRRGSCRGPQCICN" or "GSMCIPCFTTNHQMAAKCDACCGSR RGSCRGPQCICN" or "GSMCIPCFTTNHNMAAKCDACCGGRGRGSCRGPQCICN" or "GSMCIPCFTTNPNMAAKCDACCGSRGRGSCRGPQCICN" or "GSMCIPC
  MOD_RES (21)..(89): CONT. FROM ABOVE: FTTNPNMAAKCDACCGGKGRGSCRGPQCICN" or "G SMCIPCFTTNHNMAAKCDACCGSRGRGSCRGPQCICN" or "GSMCIPCFTTNPNM AAKCRDCCGGRGSCRGPQCICN" or "GSMCMPCFTTNPNMAAKCDDCCGSRGRGS CRGPQCICN" or "GSMCIPCFTTNPNMAARCNACCGSRRGSCRGPQCIC" or
  MOD_RES (21)..(89): CONT. FROM ABOVE: "GSMCIPCFTTNPNMAAKCNACCGSRRGSCRGPQCICI " or "GSMCMPCFTTDHQMARACDDCCGGKGRGKCYGPQCLCR" or "GSMCMPC FTTDHQMARRCDDCCGGKGRGKCYGPQCLCR" or "GSMCMPCFTTDHQMARKCDD CCGGAGRGKCYGPQCLCR" or "GSMCMPCFTTDHQMARACDDCCGGAGRGKCYG
  MOD_RES (21)..(89): CONT. FROM ABOVE: PQCLCR" or "GSMCMPCFTTDHQMARRCDDCCGGAG RGKCYGPQCLCR" or "GSMCMPCFTTDHQMARKCDDCCGGRGRGKCYGPQCLCR" or "GSMCMPCFTTDHQMARACDDCCGGRGRGKCYGPQCLCR" or "GSMCMPCF TTDHQMARKCDDCCGGKGRGACYGPQCLCR" or "GSMCMPCFTTDHQMARACDD
  MOD_RES (21)..(89): CONT. FROM ABOVE: CCGGKGRGACYGPQCLCR" or "GSMCMPCFTTDHQM ARRCDDCCGGKGRGACYGPQCLCR" or "GSMCMPCFTTDHQMARKCDDCCGGAGR GACYGPQCLCR" or "GSMCMPCFTTDHQMARACDDCCGGAGRGACYGPQCLCR" or "GSMCMPCFTTDHQMARRCDDCCGGAGRGACYGPQCLCR" or "GSMCMPCF
  MOD_RES (21)..(89): CONT. FROM ABOVE: TTDHQMARKCDDCCGGRGRGACYGPQCLCR" or "GS MCMPCFTTDHQMARACDDCCGGRGRGACYGPQCLCR" or "GSMCMPCFTTDHQMA RRCDDCCGGRGRGACYGPQCLCR" or "GSMCMPCFTTDHQMARKCDDCCGGKGRG RCYGPQCLCR" or "GSMCMPCFTTDHQMARACDDCCGGKGRGRCYGPQCLCR"
  MOD_RES (21)..(89): CONT. FROM ABOVE: or "GSMCMPCFTTDHQMARKCDDCCGGAGRGRCYGPQ CLCR" or "GSMCMPCFTTDHQMARACDDCCGGAGRGRCYGPQCLCR" or "GSM CMPCFTTDHQMARRCDDCCGGAGRGRCYGPQCLCR" or "GSMCMPCFTTDHQMAR ACDDCCGGRGRGRCYGPQCLCR" or "GSKCMPCFTTDHQMARRCDDCCGGRGRG
  MOD_RES (21)..(89): CONT. FROM ABOVE: RCYGPQCLCR" or "GSACAPCFTTDHQAARRCDDCC GGRGRGRCYGPQCLCR" or "GSKCAPCFTTDHQAARRCDDCCGGRGRGRCYGPQC LCR" or "GSMCMPCFTTDHQMARCDDCCGGGRGKCYGPQCLCR" or "GSMCMP CFTTDHQMARCDDCCGGGRGCYGPQCLCR" or "GSKCMPCFTTDHQMARCDDCC
  MOD_RES (21)..(89): CONT. FROM ABOVE: GGGRGCYGPQCLCR" or "GSACAPCFTTDHQAARCD DCCGGGRGKCYGPQCLCR" or "GSACAPCFTTDHQAARCDDCCGGGRGCYGPQCL CR" or "GSKCAPCFTTDHQAARCDDCCGGGRGCYGPQCLCR" or "GSMCMPCF TTDHQMARKCDDCCGGKGRGKCYGPQCLCRGAGAAGG" or "GSMCMPCFTTDHQ
  MOD_RES (21)..(89): CONT. FROM ABOVE: MARACDDCCGGKGRGKCYGPQCLCRGAGAAGG" or " GSMCMPCFTTDHQMARRCDDCCGGKGRGKCYGPQCLCRGAGAAGG" or "GSMCMP CFTTDHQMARKCDDCCGGAGRGKCYGPQCLCRGAGAAGG" or "GSMCMPCFTTDH QMARACDDCCGGAGRGKCYGPQCLCRGAGAAGG" or "GSMCMPCFTTDHQMARR
  MOD_RES (21)..(89): CONT. FROM ABOVE: CDDCCGGAGRGKCYGPQCLCRGAGAAGG" or "GSMC MPCFTTDHQMARKCDDCCGGRGRGKCYGPQCLCRGAGAAGG" or "GSMCMPCFTT DHQMARACDDCCGGRGRGKCYGPQCLCRGAGAAGG" or "GSMCMPCFTTDHQMAR RCDDCCGGRGRGKCYGPQCLCRGAGAAGG" or "GSMCMPCFTTDHQMARKCDDC
  MOD_RES (21)..(89): CONT. FROM ABOVE: CGGKGRGACYGPQCLCRGAGAAGG" or "GSMCMPCF TTDHQMARACDDCCGGKGRGACYGPQCLCRGAGAAGG" or "GSMCMPCFTTDHQM ARRCDDCCGGKGRGACYGPQCLCRGAGAAGG" or "GSMCMPCFTTDHQMARKCDD CCGGAGRGACYGPQCLCRGAGAAGG" or "GSMCMPCFTTDHQMARACDDCCGGA
  MOD_RES (21)..(89): CONT. FROM ABOVE: GRGACYGPQCLCRGAGAAGG" or "GSMCMPCFTTDH QMARRCDDCCGGAGRGACYGPQCLCRGAGAAGG" or "GSMCMPCFTTDHQMARKC DDCCGGRGRGACYGPQCLCRGAGAAGG" or "GSMCMPCFTTDHQMARACDDCCGG RGRGACYGPQCLCRGAGAAGG" or "GSMCMPCFTTDHQMARRCDDCCGGRGRGA
  MOD_RES (21)..(89): CONT. FROM ABOVE: CYGPQCLCRGAGAAGG" or "GSMCMPCFTTDHQMAR KCDDCCGGKGRGRCYGPQCLCRGAGAAGG" or "GSMCMPCFTTDHQMARACDDCC GGKGRGRCYGPQCLCRGAGAAGG" or "GSMCMPCFTTDHQMARRCDDCCGGKGRG RCYGPQCLCRGAGAAGG" or "GSMCMPCFTTDHQMARKCDDCCGGAGRGRCYGP
  MOD_RES (21)..(89): CONT. FROM ABOVE: QCLCRGAGAAGG" or "GSMCMPCFTTDHQMARACDD CCGGAGRGRCYGPQCLCRGAGAAGG" or "GSMCMPCFTTDHQMARRCDDCCGGAG RGRCYGPQCLCRGAGAAGG" or "GSMCMPCFTTDHQMARKCDDCCGGRGRGRCYG PQCLCRGAGAAGG" or "GSMCMPCFTTDHQMARACDDCCGGRGRGRCYGPQCLC
  MOD_RES (21)..(89): CONT. FROM ABOVE: RGAGAAGG" or "GSMCMPCFTTDHQMARRCDDCCGG RGRGRCYGPQCLCRGAGAAGG" or "GSKCMPCFTTDHQMARRCDDCCGGRGRGRC YGPQCLCRGAGAAGG" or "GSACAPCFTTDHQAARRCDDCCGGRGRGRCYGPQCL CRGAGAAGG" or "GSKCAPCFTTDHQAARRCDDCCGGRGRGRCYGPQCLCRGAG
  MOD_RES (21)..(89): CONT. FROM ABOVE: AAGG" or "GSMCMPCFTTDHQMARCDDCCGGGRGKC YGPQCLCRGAGAAGG" or "GSMCMPCFTTDHQMARCDDCCGGGRGCYGPQCLCRG AGAAGG" or "GSKCMPCFTTDHQMARCDDCCGGGRGCYGPQCLCRGAGAAGG" o r "GSACAPCFTTDHQAARCDDCCGGGRGKCYGPQCLCRGAGAAGG" or "GSAC
  MOD_RES (21)..(89): CONT. FROM ABOVE: APCFTTDHQAARCDDCCGGGRGCYGPQCLCRGAGAAGG " or "GSKCAPCFTTDHQAARCDDCCGGGRGCYGPQCLCRGAGAAGG" or "GSM CMPCFTTDHQMVRKCDDCCGGKGRGKCYGPQCLCR" or "GSMCMPCFTTDHQMVR VCDDCCGGKGRGKCYGPQCLCR" or "GSMCMPCFTTDHQMVRRCDDCCGGKGRG
  MOD_RES (21)..(89): CONT. FROM ABOVE: KCYGPQCLCR" or "GSMCMPCFTTDHQMVRKCDDCC GGVGRGKCYGPQCLCR" or "GSMCMPCFTTDHQMVRVCDDCCGGVGRGKCYGPQC LCR" or "GSMCMPCFTTDHQMVRRCDDCCGGVGRGKCYGPQCLCR" or "GSMC MPCFTTDHQMVRKCDDCCGGRGRGKCYGPQCLCR" or "GSMCMPCFTTDHQMVR
  MOD_RES (21)..(89): CONT. FROM ABOVE: VCDDCCGGRGRGKCYGPQCLCR" or "GSMCMPCFTT DHQMVRRCDDCCGGRGRGKCYGPQCLCR" or "GSMCMPCFTTDHQMVRKCDDCCG GKGRGVCYGPQCLCR" or "GSMCMPCFTTDHQMVRVCDDCCGGKGRGVCYGPQCL CR" or "GSMCMPCFTTDHQMVRRCDDCCGGKGRGVCYGPQCLCR" or "GSMC
  MOD_RES (21)..(89): CONT. FROM ABOVE: MPCFTTDHQMVRKCDDCCGGVGRGVCYGPQCLCR" or "GSMCMPCFTTDHQMVRVCDDCCGGVGRGVCYGPQCLCR" or "GSMCMPCFTTD HQMVRRCDDCCGGVGRGVCYGPQCLCR" or "GSMCMPCFTTDHQMVRKCDDCCGG RGRGVCYGPQCLCR" or "GSMCMPCFTTDHQMVRVCDDCCGGRGRGVCYGPQCL
  MOD_RES (21)..(89): CONT. FROM ABOVE: CR" or "GSMCMPCFTTDHQMVRRCDDCCGGRGRGVC YGPQCLCR" or "GSMCMPCFTTDHQMVRKCDDCCGGKGRGRCYGPQCLCR" or "GSMCMPCFTTDHQMVRVCDDCCGGKGRGRCYGPQCLCR" or "GSMCMPCFTTDH QMVRRCDDCCGGKGRGRCYGPQCLCR" or "GSMCMPCFTTDHQMVRKCDDCCGG
  MOD_RES (21)..(89): CONT. FROM ABOVE: VGRGRCYGPQCLCR" or "GSMCMPCFTTDHQMVRVC DDCCGGVGRGRCYGPQCLCR" or "GSMCMPCFTTDHQMVRRCDDCCGGVGRGRCY GPQCLCR" or "GSMCMPCFTTDHQMVRKCDDCCGGRGRGRCYGPQCLCR" or " GSMCMPCFTTDHQMVRVCDDCCGGRGRGRCYGPQCLCR" or "GSMCMPCFTTDH
  MOD_RES (21)..(89): CONT. FROM ABOVE: QMVRRCDDCCGGRGRGRCYGPQCLCR" or "GSKCMP CFTTDHQMVRRCDDCCGGRGRGRCYGPQCLCR" or "GSVCVPCFTTDHQVVRRCD DCCGGRGRGRCYGPQCLCR" or "GSKCVPCFTTDHQVVRRCDDCCGGRGRGRCYG PQCLCR" or "GSMCMPCFTTDHQMVRCDDCCGGGRGKCYGPQCLCR" or "GS
  MOD_RES (21)..(89): CONT. FROM ABOVE: MCMPCFTTDHQMVRCDDCCGGGRGCYGPQCLCR" or "GSKCMPCFTTDHQMVRCDDCCGGGRGCYGPQCLCR" or "GSVCVPCFTTDHQVV RCDDCCGGGRGKCYGPQCLCR" or "GSVCVPCFTTDHQVVRCDDCCGGGRGCYGP QCLCR" or "GSKCVPCFTTDHQVVRCDDCCGGGRGCYGPQCLCR" or "GSMC
  MOD_RES (21)..(89): CONT. FROM ABOVE: MPCFTTDHQMVRKCDDCCGGKGRGKCYGPQCLCRGAGA AGG" or "GSMCMPCFTTDHQMVRVCDDCCGGKGRGKCYGPQCLCRGAGAAGG" o r "GSMCMPCFTTDHQMVRRCDDCCGGKGRGKCYGPQCLCRGAGAAGG" or "GSM CMPCFTTDHQMVRKCDDCCGGVGRGKCYGPQCLCRGAGAAGG" or "GSMCMPCF
  MOD_RES (21)..(89): CONT. FROM ABOVE: TTDHQMVRVCDDCCGGVGRGKCYGPQCLCRGAGAAGG" or "GSMCMPCFTTDHQMVRRCDDCCGGVGRGKCYGPQCLCRGAGAAGG" or "G SMCMPCFTTDHQMVRKCDDCCGGRGRGKCYGPQCLCRGAGAAGG" or "GSMCMPC FTTDHQMVRVCDDCCGGRGRGKCYGPQCLCRGAGAAGG" or "GSMCMPCFTTDH
  MOD_RES (21)..(89): CONT. FROM ABOVE: QMVRRCDDCCGGRGRGKCYGPQCLCRGAGAAGG" or "GSMCMPCFTTDHQMVRKCDDCCGGKGRGVCYGPQCLCRGAGAAGG" or "GSMCM PCFTTDHQMVRVCDDCCGGKGRGVCYGPQCLCRGAGAAGG" or "GSMCMPCFTTD HQMVRRCDDCCGGKGRGVCYGPQCLCRGAGAAGG" or "GSMCMPCFTTDHQMVR
  MOD_RES (21)..(89): CONT. FROM ABOVE: KCDDCCGGVGRGVCYGPQCLCRGAGAAGG" or "GSM CMPCFTTDHQMVRVCDDCCGGVGRGVCYGPQCLCRGAGAAGG" or "GSMCMPCFT TDHQMVRRCDDCCGGVGRGVCYGPQCLCRGAGAAGG" or "GSMCMPCFTTDHQMV RKCDDCCGGRGRGVCYGPQCLCRGAGAAGG" or "GSMCMPCFTTDHQMVRVCDD
  MOD_RES (21)..(89): CONT. FROM ABOVE: CCGGRGRGVCYGPQCLCRGAGAAGG" or "GSMCMPC FTTDHQMVRRCDDCCGGRGRGVCYGPQCLCRGAGAAGG" or "GSMCMPCFTTDHQ MVRKCDDCCGGKGRGRCYGPQCLCRGAGAAGG" or "GSMCMPCFTTDHQMVRVCD DCCGGKGRGRCYGPQCLCRGAGAAGG" or "GSMCMPCFTTDHQMVRRCDDCCGG
  MOD_RES (21)..(89): CONT. FROM ABOVE: KGRGRCYGPQCLCRGAGAAGG" or "GSMCMPCFTTD HQMVRKCDDCCGGVGRGRCYGPQCLCRGAGAAGG" or "GSMCMPCFTTDHQMVRV CDDCCGGVGRGRCYGPQCLCRGAGAAGG" or "GSMCMPCFTTDHQMVRRCDDCCG GVGRGRCYGPQCLCRGAGAAGG" or "GSMCMPCFTTDHQMVRKCDDCCGGRGRG
  MOD_RES (21)..(89): CONT. FROM ABOVE: RCYGPQCLCRGAGAAGG" or "GSMCMPCFTTDHQMV RVCDDCCGGRGRGRCYGPQCLCRGAGAAGG" or "GSMCMPCFTTDHQMVRRCDDC CGGRGRGRCYGPQCLCRGAGAAGG" or "GSKCMPCFTTDHQMVRRCDDCCGGRGR GRCYGPQCLCRGAGAAGG" or "GSVCVPCFTTDHQVVRRCDDCCGGRGRGRCYG
  MOD_RES (21)..(89): CONT. FROM ABOVE: PQCLCRGAGAAGG" or "GSKCVPCFTTDHQVVRRCD DCCGGRGRGRCYGPQCLCRGAGAAGG" or "GSMCMPCFTTDHQMVRCDDCCGGGR GKCYGPQCLCRGAGAAGG" or "GSMCMPCFTTDHQMVRCDDCCGGGRGCYGPQCL CRGAGAAGG" or "GSKCMPCFTTDHQMVRCDDCCGGGRGCYGPQCLCRGAGAAG
  MOD_RES (21)..(89): CONT. FROM ABOVE: G" or "GSVCVPCFTTDHQVVRCDDCCGGGRGKCYGP QCLCRGAGAAGG" or "GSVCVPCFTTDHQVVRCDDCCGGGRGCYGPQCLCRGAGA AGG" or "GSKCVPCFTTDHQVVRCDDCCGGGRGCYGPQCLCRGAGAAGG" or " GSMCMPCFTTDHQMLRKCDDCCGGKGRGKCYGPQCLCR" or "GSMCMPCFTTDH
  MOD_RES (21)..(89): CONT. FROM ABOVE: QMLRLCDDCCGGKGRGKCYGPQCLCR" or "GSMCMP CFTTDHQMLRRCDDCCGGKGRGKCYGPQCLCR" or "GSMCMPCFTTDHQMLRKCD DCCGGLGRGKCYGPQCLCR" or "GSMCMPCFTTDHQMLRLCDDCCGGLGRGKCYG PQCLCR" or "GSMCMPCFTTDHQMLRRCDDCCGGLGRGKCYGPQCLCR" or "
  MOD_RES (21)..(89): CONT. FROM ABOVE: GSMCMPCFTTDHQMLRKCDDCCGGRGRGKCYGPQCLCR " or "GSMCMPCFTTDHQMLRLCDDCCGGRGRGKCYGPQCLCR" or "GSMCMPC FTTDHQMLRRCDDCCGGRGRGKCYGPQCLCR" or "GSMCMPCFTTDHQMLRKCDD CCGGKGRGLCYGPQCLCR" or "GSMCMPCFTTDHQMLRLCDDCCGGKGRGLCYG
  MOD_RES (21)..(89): CONT. FROM ABOVE: PQCLCR" or "GSMCMPCFTTDHQMLRRCDDCCGGKG RGLCYGPQCLCR" or "GSMCMPCFTTDHQMLRKCDDCCGGLGRGLCYGPQCLCR" or "GSMCMPCFTTDHQMLRLCDDCCGGLGRGLCYGPQCLCR" or "GSMCMPCF TTDHQMLRRCDDCCGGLGRGLCYGPQCLCR" or "GSMCMPCFTTDHQMLRKCDD
  MOD_RES (21)..(89): CONT. FROM ABOVE: CCGGRGRGLCYGPQCLCR" or "GSMCMPCFTTDHQM LRLCDDCCGGRGRGLCYGPQCLCR" or "GSMCMPCFTTDHQMLRRCDDCCGGRGR GLCYGPQCLCR" or "GSMCMPCFTTDHQMLRKCDDCCGGKGRGRCYGPQCLCR" or "GSMCMPCFTTDHQMLRLCDDCCGGKGRGRCYGPQCLCR" or "GSMCMPCF
  MOD_RES (21)..(89): CONT. FROM ABOVE: TTDHQMLRRCDDCCGGKGRGRCYGPQCLCR" or "GS MCMPCFTTDHQMLRKCDDCCGGLGRGRCYGPQCLCR" or "GSMCMPCFTTDHQML RLCDDCCGGLGRGRCYGPQCLCR" or "GSMCMPCFTTDHQMLRRCDDCCGGLGRG RCYGPQCLCR" or "GSMCMPCFTTDHQMLRKCDDCCGGRGRGRCYGPQCLCR"
  MOD_RES (21)..(89): CONT. FROM ABOVE: or "GSMCMPCFTTDHQMLRLCDDCCGGRGRGRCYGPQ CLCR" or "GSMCMPCFTTDHQMLRRCDDCCGGRGRGRCYGPQCLCR" or "GSK CMPCFTTDHQMLRRCDDCCGGRGRGRCYGPQCLCR" or "GSLCLPCFTTDHQLLR RCDDCCGGRGRGRCYGPQCLCR" or "GSKCLPCFTTDHQLLRRCDDCCGGRGRG
  MOD_RES (21)..(89): CONT. FROM ABOVE: RCYGPQCLCR" or "GSMCMPCFTTDHQMLRCDDCCG GGRGKCYGPQCLCR" or "GSMCMPCFTTDHQMLRCDDCCGGGRGCYGPQCLCR" or "GSKCMPCFTTDHQMLRCDDCCGGGRGCYGPQCLCR" or "GSLCLPCFTTDH QLLRCDDCCGGGRGKCYGPQCLCR" or "GSLCLPCFTTDHQLLRCDDCCGGGRG
  MOD_RES (21)..(89): CONT. FROM ABOVE: CYGPQCLCR" or "GSKCLPCFTTDHQLLRCDDCCGG GRGCYGPQCLCR" or "GSMCMPCFTTDHQMLRKCDDCCGGKGRGKCYGPQCLCRG AGAAGG" or "GSMCMPCFTTDHQMLRLCDDCCGGKGRGKCYGPQCLCRGAGAAGG " or "GSMCMPCFTTDHQMLRRCDDCCGGKGRGKCYGPQCLCRGAGAAGG" or
  MOD_RES (21)..(89): CONT. FROM ABOVE: "GSMCMPCFTTDHQMLRKCDDCCGGLGRGKCYGPQCLC RGAGAAGG" or "GSMCMPCFTTDHQMLRLCDDCCGGLGRGKCYGPQCLCRGAGAA GG" or "GSMCMPCFTTDHQMLRRCDDCCGGLGRGKCYGPQCLCRGAGAAGG" or "GSMCMPCFTTDHQMLRKCDDCCGGRGRGKCYGPQCLCRGAGAAGG" or "GSM
  MOD_RES (21)..(89): CONT. FROM ABOVE: CMPCFTTDHQMLRLCDDCCGGRGRGKCYGPQCLCRGAG AAGG" or "GSMCMPCFTTDHQMLRRCDDCCGGRGRGKCYGPQCLCRGAGAAGG" or "GSMCMPCFTTDHQMLRKCDDCCGGKGRGLCYGPQCLCRGAGAAGG" or "GS MCMPCFTTDHQMLRLCDDCCGGKGRGLCYGPQCLCRGAGAAGG" or "GSMCMPC
  MOD_RES (21)..(89): CONT. FROM ABOVE: FTTDHQMLRRCDDCCGGKGRGLCYGPQCLCRGAGAAGG " or "GSMCMPCFTTDHQMLRKCDDCCGGLGRGLCYGPQCLCRGAGAAGG" or " GSMCMPCFTTDHQMLRLCDDCCGGLGRGLCYGPQCLCRGAGAAGG" or "GSMCMP CFTTDHQMLRRCDDCCGGLGRGLCYGPQCLCRGAGAAGG" or "GSMCMPCFTTD
  MOD_RES (21)..(89): CONT. FROM ABOVE: HQMLRKCDDCCGGRGRGLCYGPQCLCRGAGAAGG" or "GSMCMPCFTTDHQMLRLCDDCCGGRGRGLCYGPQCLCRGAGAAGG" or "GSMC MPCFTTDHQMLRRCDDCCGGRGRGLCYGPQCLCRGAGAAGG" or "GSMCMPCFTT DHQMLRKCDDCCGGKGRGRCYGPQCLCRGAGAAGG" or "GSMCMPCFTTDHQML
  MOD_RES (21)..(89): CONT. FROM ABOVE: RLCDDCCGGKGRGRCYGPQCLCRGAGAAGG" or "GS MCMPCFTTDHQMLRRCDDCCGGKGRGRCYGPQCLCRGAGAAGG" or "GSMCMPCF TTDHQMLRKCDDCCGGLGRGRCYGPQCLCRGAGAAGG" or "GSMCMPCFTTDHQM LRLCDDCCGGLGRGRCYGPQCLCRGAGAAGG" or "GSMCMPCFTTDHQMLRRCD
  MOD_RES (21)..(89): CONT. FROM ABOVE: DCCGGLGRGRCYGPQCLCRGAGAAGG" or "GSMCMP CFTTDHQMLRKCDDCCGGRGRGRCYGPQCLCRGAGAAGG" or "GSMCMPCFTTDH QMLRLCDDCCGGRGRGRCYGPQCLCRGAGAAGG" or "GSMCMPCFTTDHQMLRRC DDCCGGRGRGRCYGPQCLCRGAGAAGG" or "GSKCMPCFTTDHQMLRRCDDCCG
  MOD_RES (21)..(89): CONT. FROM ABOVE: GRGRGRCYGPQCLCRGAGAAGG" or "GSLCLPCFTT DHQLLRRCDDCCGGRGRGRCYGPQCLCRGAGAAGG" or "GSKCLPCFTTDHQLLR RCDDCCGGRGRGRCYGPQCLCRGAGAAGG" or "GSMCMPCFTTDHQMLRCDDCCG GGRGKCYGPQCLCRGAGAAGG" or "GSMCMPCFTTDHQMLRCDDCCGGGRGCYG
  MOD_RES (21)..(89): CONT. FROM ABOVE: PQCLCRGAGAAGG" or "GSKCMPCFTTDHQMLRCDD CCGGGRGCYGPQCLCRGAGAAGG" or "GSLCLPCFTTDHQLLRCDDCCGGGRGKC YGPQCLCRGAGAAGG" or "GSLCLPCFTTDHQLLRCDDCCGGGRGCYGPQCLCRG AGAAGG" or "GSKCLPCFTTDHQLLRCDDCCGGGRGCYGPQCLCRGAGAAGG"
  MOD_RES (21)..(89): CONT. FROM ABOVE: or "GSGCGPCFTTDHQGARKCDDCCGGKGRGKCYGPQ CLCR" or "GSGCGPCFTTDHQGARACDDCCGGKGRGKCYGPQCLCR" or "GSG CGPCFTTDHQGARRCDDCCGGKGRGKCYGPQCLCR" or "GSGCGPCFTTDHQGAR KCDDCCGGAGRGKCYGPQCLCR" or "GSGCGPCFTTDHQGARACDDCCGGAGRG
  MOD_RES (21)..(89): CONT. FROM ABOVE: KCYGPQCLCR" or "GSGCGPCFTTDHQGARRCDDCC GGAGRGKCYGPQCLCR" or "GSGCGPCFTTDHQGARKCDDCCGGRGRGKCYGPQC LCR" or "GSGCGPCFTTDHQGARACDDCCGGRGRGKCYGPQCLCR" or "GSGC GPCFTTDHQGARRCDDCCGGRGRGKCYGPQCLCR" or "GSGCGPCFTTDHQGAR
  MOD_RES (21)..(89): CONT. FROM ABOVE: KCDDCCGGKGRGACYGPQCLCR" or "GSGCGPCFTT DHQGARACDDCCGGKGRGACYGPQCLCR" or "GSGCGPCFTTDHQGARRCDDCCG GKGRGACYGPQCLCR" or "GSGCGPCFTTDHQGARKCDDCCGGAGRGACYGPQCL CR" or "GSGCGPCFTTDHQGARACDDCCGGAGRGACYGPQCLCR" or "GSGC
  MOD_RES (21)..(89): CONT. FROM ABOVE: GPCFTTDHQGARRCDDCCGGAGRGACYGPQCLCR" or "GSGCGPCFTTDHQGARKCDDCCGGRGRGACYGPQCLCR" or "GSGCGPCFTTD HQGARACDDCCGGRGRGACYGPQCLCR" or "GSGCGPCFTTDHQGARRCDDCCGG RGRGACYGPQCLCR" or "GSGCGPCFTTDHQGARKCDDCCGGKGRGRCYGPQCL
  MOD_RES (21)..(89): CONT. FROM ABOVE: CR" or "GSGCGPCFTTDHQGARACDDCCGGKGRGRC YGPQCLCR" or "GSGCGPCFTTDHQGARRCDDCCGGKGRGRCYGPQCLCR" or "GSGCGPCFTTDHQGARKCDDCCGGAGRGRCYGPQCLCR" or "GSGCGPCFTTDH QGARACDDCCGGAGRGRCYGPQCLCR" or "GSGCGPCFTTDHQGARRCDDCCGG
  MOD_RES (21)..(89): CONT. FROM ABOVE: AGRGRCYGPQCLCR" or "GSGCGPCFTTDHQGARKC DDCCGGRGRGRCYGPQCLCR" or "GSGCGPCFTTDHQGARACDDCCGGRGRGRCY GPQCLCR" or "GSGCGPCFTTDHQGARRCDDCCGGRGRGRCYGPQCLCR" or " GSKCGPCFTTDHQGARRCDDCCGGRGRGRCYGPQCLCR" or "GSGCGPCFTTDH
  MOD_RES (21)..(89): CONT. FROM ABOVE: QGARCDDCCGGGRGKCYGPQCLCR" or "GSGCGPCF TTDHQGARCDDCCGGGRGCYGPQCLCR" or "GSKCGPCFTTDHQGARCDDCCGGG RGCYGPQCLCR" or "GSACAPCFTTDHQAARACDDCCGGKGRGKCYGPQCLCR" or "GSACAPCFTTDHQAARRCDDCCGGKGRGKCYGPQCLCR" or "GSACAPCF
  MOD_RES (21)..(89): CONT. FROM ABOVE: TTDHQAARKCDDCCGGAGRGKCYGPQCLCR" or "GS ACAPCFTTDHQAARACDDCCGGAGRGKCYGPQCLCR" or "GSACAPCFTTDHQAA RRCDDCCGGAGRGKCYGPQCLCR" or "GSACAPCFTTDHQAARKCDDCCGGRGRG KCYGPQCLCR" or "GSACAPCFTTDHQAARACDDCCGGRGRGKCYGPQCLCR"
  MOD_RES (21)..(89): CONT. FROM ABOVE: or "GSACAPCFTTDHQAARKCDDCCGGKGRGACYGPQ CLCR" or "GSACAPCFTTDHQAARACDDCCGGKGRGACYGPQCLCR" or "GSA CAPCFTTDHQAARRCDDCCGGKGRGACYGPQCLCR" or "GSACAPCFTTDHQAAR KCDDCCGGAGRGACYGPQCLCR" or "GSACAPCFTTDHQAARACDDCCGGAGRG
  MOD_RES (21)..(89): CONT. FROM ABOVE: ACYGPQCLCR" or "GSACAPCFTTDHQAARRCDDCC GGAGRGACYGPQCLCR" or "GSACAPCFTTDHQAARKCDDCCGGRGRGACYGPQC LCR" or "GSACAPCFTTDHQAARACDDCCGGRGRGACYGPQCLCR" or "GSAC APCFTTDHQAARRCDDCCGGRGRGACYGPQCLCR" or "GSACAPCFTTDHQAAR
  MOD_RES (21)..(89): CONT. FROM ABOVE: KCDDCCGGKGRGRCYGPQCLCR" or "GSACAPCFTT DHQAARACDDCCGGKGRGRCYGPQCLCR" or "GSACAPCFTTDHQAARRCDDCCG GKGRGRCYGPQCLCR" or "GSACAPCFTTDHQAARKCDDCCGGAGRGRCYGPQCL CR" or "GSACAPCFTTDHQAARACDDCCGGAGRGRCYGPQCLCR" or "GSAC
  MOD_RES (21)..(89): CONT. FROM ABOVE: APCFTTDHQAARRCDDCCGGAGRGRCYGPQCLCR" or "GSACAPCFTTDHQAARKCDDCCGGRGRGRCYGPQCLCR" or "GSACAPCFTTD HQAARACDDCCGGRGRGRCYGPQCLCR" or "GSICIPCFTTDHQIARKCDDCCGG KGRGKCYGPQCLCR" or "GSICIPCFTTDHQIARACDDCCGGKGRGKCYGPQCL
  MOD_RES (21)..(89): CONT. FROM ABOVE: CR" or "GSICIPCFTTDHQIARRCDDCCGGKGRGKC YGPQCLCR" or "GSICIPCFTTDHQIARKCDDCCGGAGRGKCYGPQCLCR" or "GSICIPCFTTDHQIARACDDCCGGAGRGKCYGPQCLCR" or "GSICIPCFTTDH QIARRCDDCCGGAGRGKCYGPQCLCR" or "GSICIPCFTTDHQIARKCDDCCGG
  MOD_RES (21)..(89): CONT. FROM ABOVE: RGRGKCYGPQCLCR" or "GSICIPCFTTDHQIARAC DDCCGGRGRGKCYGPQCLCR" or "GSICIPCFTTDHQIARKCDDCCGGKGRGACY GPQCLCR" or "GSICIPCFTTDHQIARACDDCCGGKGRGACYGPQCLCR" or " GSICIPCFTTDHQIARRCDDCCGGKGRGACYGPQCLCR" or "GSICIPCFTTDH
  MOD_RES (21)..(89): CONT. FROM ABOVE: QIARKCDDCCGGAGRGACYGPQCLCR" or "GSICIP CFTTDHQIARACDDCCGGAGRGACYGPQCLCR" or "GSICIPCFTTDHQIARRCD DCCGGAGRGACYGPQCLCR" or "GSICIPCFTTDHQIARKCDDCCGGRGRGACYG PQCLCR" or "GSICIPCFTTDHQIARACDDCCGGRGRGACYGPQCLCR" or "
  MOD_RES (21)..(89): CONT. FROM ABOVE: GSICIPCFTTDHQIARRCDDCCGGRGRGACYGPQCLCR " or "GSICIPCFTTDHQIARKCDDCCGGKGRGRCYGPQCLCR" or "GSICIPC FTTDHQIARACDDCCGGKGRGRCYGPQCLCR" or "GSICIPCFTTDHQIARRCDD CCGGKGRGRCYGPQCLCR" or "GSICIPCFTTDHQIARKCDDCCGGAGRGRCYG
  MOD_RES (21)..(89): CONT. FROM ABOVE: PQCLCR" or "GSICIPCFTTDHQIARACDDCCGGAG RGRCYGPQCLCR" or "GSICIPCFTTDHQIARRCDDCCGGAGRGRCYGPQCLCR" or "GSICIPCFTTDHQIARKCDDCCGGRGRGRCYGPQCLCR" or "GSICIPCF TTDHQIARACDDCCGGRGRGRCYGPQCLCR" or "GSICIPCFTTDHQIARRCDD
  MOD_RES (21)..(89): CONT. FROM ABOVE: CCGGRGRGRCYGPQCLCR" or "GSKCIPCFTTDHQI ARRCDDCCGGRGRGRCYGPQCLCR" or "GSICIPCFTTDHQIARCDDCCGGGRGK CYGPQCLCR" or "GSICIPCFTTDHQIARCDDCCGGGRGCYGPQCLCR" or "G SKCIPCFTTDHQIARCDDCCGGGRGCYGPQCLCR" or "GSTCTPCFTTDHQTAR
  MOD_RES (21)..(89): CONT. FROM ABOVE: KCDDCCGGKGRGKCYGPQCLCR" or "GSTCTPCFTT DHQTARACDDCCGGKGRGKCYGPQCLCR" or "GSTCTPCFTTDHQTARRCDDCCG GKGRGKCYGPQCLCR" or "GSTCTPCFTTDHQTARKCDDCCGGAGRGKCYGPQCL CR" or "GSTCTPCFTTDHQTARACDDCCGGAGRGKCYGPQCLCR" or "GSTC
  MOD_RES (21)..(89): CONT. FROM ABOVE: TPCFTTDHQTARRCDDCCGGAGRGKCYGPQCLCR" or "GSTCTPCFTTDHQTARKCDDCCGGRGRGKCYGPQCLCR" or "GSTCTPCFTTD HQTARACDDCCGGRGRGKCYGPQCLCR" or "GSTCTPCFTTDHQTARRCDDCCGG RGRGKCYGPQCLCR" or "GSTCTPCFTTDHQTARKCDDCCGGKGRGACYGPQCL
  MOD_RES (21)..(89): CONT. FROM ABOVE: CR" or "GSTCTPCFTTDHQTARACDDCCGGKGRGAC YGPQCLCR" or "GSTCTPCFTTDHQTARRCDDCCGGKGRGACYGPQCLCR" or "GSTCTPCFTTDHQTARKCDDCCGGAGRGACYGPQCLCR" or "GSTCTPCFTTDH QTARACDDCCGGAGRGACYGPQCLCR" or "GSTCTPCFTTDHQTARRCDDCCGG
  MOD_RES (21)..(89): CONT. FROM ABOVE: AGRGACYGPQCLCR" or "GSTCTPCFTTDHQTARKC DDCCGGRGRGACYGPQCLCR" or "GSTCTPCFTTDHQTARACDDCCGGRGRGACY GPQCLCR" or "GSTCTPCFTTDHQTARRCDDCCGGRGRGACYGPQCLCR" or " GSTCTPCFTTDHQTARKCDDCCGGKGRGRCYGPQCLCR" or "GSTCTPCFTTDH
  MOD_RES (21)..(89): CONT. FROM ABOVE: QTARACDDCCGGKGRGRCYGPQCLCR" or "GSTCTP CFTTDHQTARRCDDCCGGKGRGRCYGPQCLCR" or "GSTCTPCFTTDHQTARKCD DCCGGAGRGRCYGPQCLCR" or "GSTCTPCFTTDHQTARACDDCCGGAGRGRCYG PQCLCR" or "GSTCTPCFTTDHQTARRCDDCCGGAGRGRCYGPQCLCR" or "
  MOD_RES (21)..(89): CONT. FROM ABOVE: GSTCTPCFTTDHQTARKCDDCCGGRGRGRCYGPQCLCR " or "GSTCTPCFTTDHQTARACDDCCGGRGRGRCYGPQCLCR" or "GSTCTPC FTTDHQTARRCDDCCGGRGRGRCYGPQCLCR" or "GSKCTPCFTTDHQTARRCDD CCGGRGRGRCYGPQCLCR" or "GSTCTPCFTTDHQTARCDDCCGGGRGKCYGPQ
  MOD_RES (21)..(89): CONT. FROM ABOVE: CLCR" or "GSTCTPCFTTDHQTARCDDCCGGGRGCY GPQCLCR" or "GSKCTPCFTTDHQTARCDDCCGGGRGCYGPQCLCR" or "GSV CVPCFTTDHQVARKCDDCCGGKGRGKCYGPQCLCR" or "GSVCVPCFTTDHQVAR ACDDCCGGKGRGKCYGPQCLCR" or "GSVCVPCFTTDHQVARRCDDCCGGKGRG
  MOD_RES (21)..(89): CONT. FROM ABOVE: KCYGPQCLCR" or "GSVCVPCFTTDHQVARKCDDCC GGAGRGKCYGPQCLCR" or "GSVCVPCFTTDHQVARACDDCCGGAGRGKCYGPQC LCR" or "GSVCVPCFTTDHQVARRCDDCCGGAGRGKCYGPQCLCR" or "GSVC VPCFTTDHQVARKCDDCCGGRGRGKCYGPQCLCR" or "GSVCVPCFTTDHQVAR
  MOD_RES (21)..(89): CONT. FROM ABOVE: ACDDCCGGRGRGKCYGPQCLCR" or "GSVCVPCFTT DHQVARRCDDCCGGRGRGKCYGPQCLCR" or "GSVCVPCFTTDHQVARKCDDCCG GKGRGACYGPQCLCR" or "GSVCVPCFTTDHQVARACDDCCGGKGRGACYGPQCL CR" or "GSVCVPCFTTDHQVARRCDDCCGGKGRGACYGPQCLCR" or "GSVC
  MOD_RES (21)..(89): CONT. FROM ABOVE: VPCFTTDHQVARKCDDCCGGAGRGACYGPQCLCR" or "GSVCVPCFTTDHQVARACDDCCGGAGRGACYGPQCLCR" or "GSVCVPCFTTD HQVARRCDDCCGGAGRGACYGPQCLCR" or "GSVCVPCFTTDHQVARKCDDCCGG RGRGACYGPQCLCR" or "GSVCVPCFTTDHQVARACDDCCGGRGRGACYGPQCL
  MOD_RES (21)..(89): CONT. FROM ABOVE: CR" or "GSVCVPCFTTDHQVARRCDDCCGGRGRGAC YGPQCLCR" or "GSVCVPCFTTDHQVARKCDDCCGGKGRGRCYGPQCLCR" or "GSVCVPCFTTDHQVARACDDCCGGKGRGRCYGPQCLCR" or "GSVCVPCFTTDH QVARRCDDCCGGKGRGRCYGPQCLCR" or "GSVCVPCFTTDHQVARKCDDCCGG
  MOD_RES (21)..(89): CONT. FROM ABOVE: AGRGRCYGPQCLCR" or "GSVCVPCFTTDHQVARAC DDCCGGAGRGRCYGPQCLCR" or "GSVCVPCFTTDHQVARRCDDCCGGAGRGRCY GPQCLCR" or "GSVCVPCFTTDHQVARKCDDCCGGRGRGRCYGPQCLCR" or " GSVCVPCFTTDHQVARACDDCCGGRGRGRCYGPQCLCR" or "GSVCVPCFTTDH
  MOD_RES (21)..(89): CONT. FROM ABOVE: QVARRCDDCCGGRGRGRCYGPQCLCR" or "GSKCVP CFTTDHQVARRCDDCCGGRGRGRCYGPQCLCR" or "GSVCVPCFTTDHQVARCDD CCGGGRGKCYGPQCLCR" or "GSVCVPCFTTDHQVARCDDCCGGGRGCYGPQCLC R" or "GSKCVPCFTTDHQVARCDDCCGGGRGCYGPQCLCR" or "GSLCLPCF
  MOD_RES (21)..(89): CONT. FROM ABOVE: TTDHQLARKCDDCCGGKGRGKCYGPQCLCR" or "GS LCLPCFTTDHQLARACDDCCGGKGRGKCYGPQCLCR" or "GSLCLPCFTTDHQLA RRCDDCCGGKGRGKCYGPQCLCR" or "GSLCLPCFTTDHQLARKCDDCCGGAGRG KCYGPQCLCR" or "GSLCLPCFTTDHQLARACDDCCGGAGRGKCYGPQCLCR"
  MOD_RES (21)..(89): CONT. FROM ABOVE: or "GSLCLPCFTTDHQLARRCDDCCGGAGRGKCYGPQ CLCR" or "GSLCLPCFTTDHQLARKCDDCCGGRGRGKCYGPQCLCR" or "GSL CLPCFTTDHQLARACDDCCGGRGRGKCYGPQCLCR" or "GSLCLPCFTTDHQLAR RCDDCCGGRGRGKCYGPQCLCR" or "GSLCLPCFTTDHQLARKCDDCCGGKGRG
  MOD_RES (21)..(89): CONT. FROM ABOVE: ACYGPQCLCR" or "GSLCLPCFTTDHQLARACDDCC GGKGRGACYGPQCLCR" or "GSLCLPCFTTDHQLARRCDDCCGGKGRGACYGPQC LCR" or "GSLCLPCFTTDHQLARKCDDCCGGAGRGACYGPQCLCR" or "GSLC LPCFTTDHQLARACDDCCGGAGRGACYGPQCLCR" or "GSLCLPCFTTDHQLAR
  MOD_RES (21)..(89): CONT. FROM ABOVE: RCDDCCGGAGRGACYGPQCLCR" or "GSLCLPCFTT DHQLARKCDDCCGGRGRGACYGPQCLCR" or "GSLCLPCFTTDHQLARACDDCCG GRGRGACYGPQCLCR" or "GSLCLPCFTTDHQLARRCDDCCGGRGRGACYGPQCL CR" or "GSLCLPCFTTDHQLARKCDDCCGGKGRGRCYGPQCLCR" or "GSLC
  MOD_RES (21)..(89): CONT. FROM ABOVE: LPCFTTDHQLARACDDCCGGKGRGRCYGPQCLCR" or "GSLCLPCFTTDHQLARRCDDCCGGKGRGRCYGPQCLCR" or "GSLCLPCFTTD HQLARKCDDCCGGAGRGRCYGPQCLCR" or "GSLCLPCFTTDHQLARACDDCCGG AGRGRCYGPQCLCR" or "GSLCLPCFTTDHQLARRCDDCCGGAGRGRCYGPQCL
  MOD_RES (21)..(89): CONT. FROM ABOVE: CR" or "GSLCLPCFTTDHQLARKCDDCCGGRGRGRC YGPQCLCR" or "GSLCLPCFTTDHQLARACDDCCGGRGRGRCYGPQCLCR" or "GSLCLPCFTTDHQLARRCDDCCGGRGRGRCYGPQCLCR" or "GSKCLPCFTTDH QLARRCDDCCGGRGRGRCYGPQCLCR" or "GSLCLPCFTTDHQLARCDDCCGGG
  MOD_RES (21)..(89): CONT. FROM ABOVE: RGKCYGPQCLCR" or "GSLCLPCFTTDHQLARCDDC CGGGRGCYGPQCLCR" or "GSKCLPCFTTDHQLARCDDCCGGGRGCYGPQCLCR" or "GSSCSPCFTTDHQSARKCDDCCGGKGRGKCYGPQCLCR" or "GSSCSPCF TTDHQSARACDDCCGGKGRGKCYGPQCLCR" or "GSSCSPCFTTDHQSARRCDD
  MOD_RES (21)..(89): CONT. FROM ABOVE: CCGGKGRGKCYGPQCLCR" or "GSSCSPCFTTDHQS ARKCDDCCGGAGRGKCYGPQCLCR" or "GSSCSPCFTTDHQSARACDDCCGGAGR GKCYGPQCLCR" or "GSSCSPCFTTDHQSARRCDDCCGGAGRGKCYGPQCLCR" or "GSSCSPCFTTDHQSARKCDDCCGGRGRGKCYGPQCLCR" or "GSSCSPCF
  MOD_RES (21)..(89): CONT. FROM ABOVE: TTDHQSARACDDCCGGRGRGKCYGPQCLCR" or "GS SCSPCFTTDHQSARRCDDCCGGRGRGKCYGPQCLCR" or "GSSCSPCFTTDHQSA RKCDDCCGGKGRGACYGPQCLCR" or "GSSCSPCFTTDHQSARACDDCCGGKGRG ACYGPQCLCR" or "GSSCSPCFTTDHQSARRCDDCCGGKGRGACYGPQCLCR"
  MOD_RES (21)..(89): CONT. FROM ABOVE: or "GSSCSPCFTTDHQSARKCDDCCGGAGRGACYGPQ CLCR" or "GSSCSPCFTTDHQSARACDDCCGGAGRGACYGPQCLCR" or "GSS CSPCFTTDHQSARRCDDCCGGAGRGACYGPQCLCR" or "GSSCSPCFTTDHQSAR KCDDCCGGRGRGACYGPQCLCR" or "GSSCSPCFTTDHQSARACDDCCGGRGRG
  MOD_RES (21)..(89): CONT. FROM ABOVE: ACYGPQCLCR" or "GSSCSPCFTTDHQSARRCDDCC GGRGRGACYGPQCLCR" or "GSSCSPCFTTDHQSARKCDDCCGGKGRGRCYGPQC LCR" or "GSSCSPCFTTDHQSARACDDCCGGKGRGRCYGPQCLCR" or "GSSC SPCFTTDHQSARRCDDCCGGKGRGRCYGPQCLCR" or "GSSCSPCFTTDHQSAR
  MOD_RES (21)..(89): CONT. FROM ABOVE: KCDDCCGGAGRGRCYGPQCLCR" or "GSSCSPCFTT DHQSARACDDCCGGAGRGRCYGPQCLCR" or "GSSCSPCFTTDHQSARRCDDCCG GAGRGRCYGPQCLCR" or "GSSCSPCFTTDHQSARKCDDCCGGRGRGRCYGPQCL CR" or "GSSCSPCFTTDHQSARACDDCCGGRGRGRCYGPQCLCR" or "GSSC
  MOD_RES (21)..(89): CONT. FROM ABOVE: SPCFTTDHQSARRCDDCCGGRGRGRCYGPQCLCR" or "GSKCSPCFTTDHQSARRCDDCCGGRGRGRCYGPQCLCR" or "GSSCSPCFTTD HQSARCDDCCGGGRGKCYGPQCLCR" or "GSSCSPCFTTDHQSARCDDCCGGGRG CYGPQCLCR" or "GSKCSPCFTTDHQSARCDDCCGGGRGCYGPQCLCR" or "
  MOD_RES (21)..(89): CONT. FROM ABOVE: GSMCMPCFTTDPNMARKCRDCCGGNGKCFGPQCLCNRG " or "GSMCMPCFTTDHNMAKKCRDCCGGNGKCFGYQCLCNRG" or "GSMCMPC FTTDHQTARRCRDCCGGRGRKCFGQCLCGYD" or "GSACGPCFTTDPQMAEKCSD CCGGIGTCYGPQCLCNRL" or "GSMCMPCFTTRPNMAQQCRDCCRGRGKCFGPQ
  MOD_RES (21)..(89): CONT. FROM ABOVE: CLCG" or "GSMCMPCFTTRPNMAQQCRDCCRGRGKC FGPQCLCGYD" or "GSMCMPCFTTNLNMEQECRDCCGGTGRCFGPQCLCG" or "GSGCMPCFTTDRYMARKCKECCRGYGNCFGPQCLCNRG" or "GSGCGPCFTTDA NMARKCRECCGGNGKCFGPQCLCNRE" or "GSGCGPCFTTDANMARKCRECCGG
  MOD_RES (21)..(89): CONT. FROM ABOVE: IGKCFGPQCLCNRI" or "GSMCMPCFTTRPDMAQQC RACCKGRGKCFGPQCLCG" or "GSMCIPCFTTNPNMAAKCNACCGSRRGSCRGPQ CIC" or "[sequence omitted]" or "GSCGP CFTTDPYTESKCATCCGGRGKCVGPQCLCNR" or "GSRCGPCFTTDPQTQAKCS
  MOD_RES (21)..(89): CONT. FROM ABOVE: ECCGRKGGVCKGPQCICG" or "GSCGPCFTKDPETE KKCATCCGGIGRCFGPQCLCNRG" or "GSMCMPCFTTDHQMARRCDDCCGGRGRG KCWGPQCLCR" or "GSAMCMPCFTTDHNMAKKCRDCCGGNGKCFGPQCLCNRG" or "GSCGPCFTTDWESEKKCAECCGGIGRCFGPQCLCNRK" or "GSCGPCFTT
  MOD_RES (21)..(89): CONT. FROM ABOVE: DHQTEQKCAECCGGIGKCYGPQCLCRG" or "GSCGP CFTTDRQMEQKCAECCGGIGKCYGPQCLCRG" or "GSCGPCFTTDHQTEQKCAEC CGGIGKCYGPQCLC" or "GSCMPCFTTDHQMARKCDDCCGGRGKCYGPQCLCRG" or "GSRCGPCFTTDPQTQAKCSECCGRKGGVCKGPQCICGIQ" or "GSRCPP
  MOD_RES (21)..(89): CONT. FROM ABOVE: CFTTNPNMEADCRKCCGGRGYCASYQCICPG" or "G SCGPCFTTDHNMARKCDECCGGKGRGKCFGPQCLCR" or "GSVCMPCFTTDQQMA RKCSDCCGGKGRGKCYGPQCLCR" or "GSMCGPCFTTDANMARKCRECCGGIGKC FGPQCLCNRI" or "GSMCGPCFTTDANMAAACRECCGGIGKCFGPQCLCNRI"
  MOD_RES (21)..(89): CONT. FROM ABOVE: or "GSMCGPCFTTDANMARKCAECCGGIGKCFGPQCL CNRI" or "GSMCGPCFTTDANMARKCRECCGGIGACFGPQCLCNRI" or "GSM CGPCFTTDANMARKCRECCGGIGKCFGPQCLCNAI" or "GSCMPCFTTRPNMAQQ CRDCCRGRGKCFGPQCLCGYD" or "GSMCMPCFTTNLNMEQECRDCCGGTGRCF
  MOD_RES (21)..(89): CONT. FROM ABOVE: GPQCLCGYD" or "GSCMPCFTTRPNMAQQCRDCCRG RGKCFGPQCLCGYD" or "MCMPCFTTDHQMARKCDDCCGGKGRGKCYGPQCLCR" or "MCMPCFTTDHQMARRCDDCCGGRGRGKCYGPQCLCR" or "MCMPCFTTDH QMARRCDDCCGGRGRGRCYGPQCLCR" or "MCMPCFTTDHQMARKCDDCCGGRG
  MOD_RES (21)..(89): CONT. FROM ABOVE: RGRCYGPQCLCR" or "MCMPCFTTDHQMARRCDDCC GGKGRGRCYGPQCLCR" or "MCMPCFTTHHRMAENCDICCGGDGRGKCYGPQCLC R" or "MCMPCFTTDTQMQERCDRCCGGGGRGKCWGPQCLCI" or "MCMPCFTT DTQMQERCDRCCGGGGRGRCWGPQCLCI" or "MCMPCFTTEQRMAIICDDCCGG
  MOD_RES (21)..(89): CONT. FROM ABOVE: FGRGKCYGPQCLCR" or "MCMPCFTTEQRMAIICDD CCGGFGRGRCYGPQCLCR" or "ICIPCFTTDHQIARRCDDCCGGRGRGKCYGPQC ICR" or "ICIPCFTTDHQIARRCDDCCGGRGRGRCYGPQCICR" or "MCMPCF TTDHRMAENCDICCGGDGRGKCYGPQCLCR" or "MCMPCFTTDHRMAENCDICC
  MOD_RES (21)..(89): CONT. FROM ABOVE: GGDGRGRCYGPQCLCR" or "MCMPCFTTEQRMAIIC DDCCGGFGRGKCYGPQCLCI" or "MCMPCFTTEQRMAIICDDCCGGFGRGRCYGP QCLCI" or "ICIPCFTTDHQIARRCDDCCGGRGRGKCYGPQCICI" or "ICIP CFTTDHQIARRCDDCCGGRGRGRCYGPQCICI" or "MCMPCFTTDHRMAENCDI
  MOD_RES (21)..(89): CONT. FROM ABOVE: CCGGDGRGKCYGPQCLCI" or "MCMPCFTTDHRMAE NCDICCGGDGRGRCYGPQCLCI" or "MCMPCFTTDTQMQEKCDRCCGGGGRGRCW GPQCLCI" or "MCMPCFTTEQRMAIKCDDCCGGFGRGRCYGPQCLCR" or "IC IPCFTTDHQIARKCDDCCGGRGRGRCYGPQCICR" or "MCMPCFTTDHRMAEKC
  MOD_RES (21)..(89): CONT. FROM ABOVE: DICCGGDGRGRCYGPQCLCR" or "MCMPCFTTDTQM QERCDRCCGGKGRGRCWGPQCLCI" or "MCMPCFTTEQRMAIICDDCCGGKGRGR CYGPQCLCR" or "ICIPCFTTDHQIARRCDDCCGGKGRGRCYGPQCICR" or " MCMPCFTTDHRMAENCDICCGGKGRGRCYGPQCLCR" or "MCMPCFTTHHRMAE
  MOD_RES (21)..(89): CONT. FROM ABOVE: NCDICCGGDGRGRCYGPQCLCR" or "MCMPCFTTDT QMQERCDRCCGGGGRGRCWGPQCLC" or "MCMPCFTTEQRMAIICDDCCGGFGRG RCYGPQCLC" or "ICIPCFTTDHQIARRCDDCCGGRGRGRCYGPQCIC" or "M CMPCFTTDHRMAENCDICCGGDGRGRCYGPQCLC" or "MCMPCFTTDHQMARRC
  MOD_RES (21)..(89): CONT. FROM ABOVE: DDCCGGRGRGRCYGPQCLCI" or "ACAPCFTTDHQA ARRCDDCCGGRGRGKCYGPQCLCR" or "ACAPCFTTDHQAARKCDDCCGGKGRGK CYGPQCLCR" or "MCMPCFTTHHRMAENCDICCGGDGRGKCYGPQCLCI" or " MCMPCFTTHHRMAENCDICCGGDGRGKCYGPQCLC" or "MCMPCFTTDHQMARR
  MOD_RES (21)..(89): CONT. FROM ABOVE: CDDCCGGRGRGRCYGPQCLC" or "MCMPCFTTHHQM AENCDICCGGDGRGKCYGPQCLCR" or "MCMPCFTTHHRMARNCDICCGGDGRGK CYGPQCLCR" or "MCMPCFTTHHRMAERCDICCGGDGRGKCYGPQCLCR" or " MCMPCFTTHHRMAENCDDCCGGDGRGKCYGPQCLCR" or "RCMPCFTTDHQMAR
  MOD_RES (21)..(89): CONT. FROM ABOVE: RCDDCCGGRGRGKCYGPQCLCR" or "ICIPCFTTDH QIARRCDDCCGGRGRGKCYGPQCLCR" or "MCLPCFTTDHQLARRCDDCCGGRGR GKCYGPQCLCR" or "MCMPCFTTEHQMARRCEECCGGRGRGKCYGPQCLCR" or "MCIPCFTTDHQMARRCEECCGGRGRGKCYGPQCLCR" or "ICIPCFTTDHQM
  MOD_RES (21)..(89): CONT. FROM ABOVE: ARRCDDCCGGRGDGKCYGPQCLCR" or "RCMPCFTT DHFMARFCDFCCGGRGRGKCYGPQCLCR" or "RCMPCFTTDHYMARYCDYCCGGR GRGKCYGPQCLCR" or "RCMPCFTTDHRMARRCDRCCGGRGRGKCYGPQCLCR" or "RCMPCFTTDHEMARECDECCGGRGRGKCYGPQCLCR" or "RCMPCFTTDH
  MOD_RES (21)..(89): CONT. FROM ABOVE: HMARHCDHCCGGRGRGKCYGPQCLCR" or "LCLPCF TTHHRLADQCDICCGGDGRGKCYGPQCLCR" or "ICIPCFTTEHQIARRCEECCG GRGRGKCYGPQCLCR" or "MCMPCFTTIYRMAHECDECCGGRGRGKCYGPQCLCR " or "MCMPCFTTGYRMAEYCDICCGGRGRGKCYGPQCLCR" or "MCMPCFTT
  MOD_RES (21)..(89): CONT. FROM ABOVE: HRRMANTCDACCGGRSRGKCYGPQCLCR" or "HCMP CFTTDHQMIRRCDDCCGGGSYGKCDGPQCLCF" or "DCMPCFTTDHRMADHCDIC CGGDDRGKCYGPQCLCR" or "MCMPCFTTDHEMERRCDDCCGIGGGGKCHGPQCL CG" or "MCMPCFTTSEQMFRRCDDCCGGWGDGKCNGPHCLCR" or "CGPCFT
  MOD_RES (21)..(89): CONT. FROM ABOVE: TDHQMEQKCAECCGGIGKCYGPQCLCNR" or "RCGP CFTTDPQTQAKCSECCGRKGGVCKGPQCICGIQY" or "MCMPCFTTDPNMAKKCR DCCGGNGKCFGPQCLCNR" or "MCMPCFTTDHNMAKKCNDCCGGYGKCFGPQCLC R" or "RCPPCFTTNPNMEADCRKCCGGRGYCASYQCICPGG" or "MCMPCFT
  MOD_RES (21)..(89): CONT. FROM ABOVE: TDPNMANKCRDCCGGGKKCFGPQCLCNR" or "MKFL YGVILIALFLTVMTATLSEARCGPCFTTDPQTQAKCSECCGRKGGVCKGPQCICGIQ Y" or "MCMPCFTTRPDMAQQCRACCKGRGKCFGPQCLCGYD" or "MKFLYGIV FIALFLTVMTATLSDAMCMPCFTTDHNMAKKCRDCCGGNGKCFGPQCLCNRG" or
  MOD_RES (21)..(89): CONT. FROM ABOVE:  "MCMPCFTTDHNMAKKCRDCCGGNGKCFGPQCLCNR" or "MKFLYGIVFITLFLTVMIATHTEAMCMPCFTTRPNMAQQCRDCCRGRGKCFG PQCLCGYD" or "MKFLYGIVFIALFLTVMIATHTEAMCMPCFTTRPNMAQQCRDC CRGRGKCFGPQCLCGYD" or "RCKPCFTTDPQMSKKCADCCGGKGKGKCYGPQC
  MOD_RES (21)..(89): CONT. FROM ABOVE: LC" or "MKFLYGIVFITLFLTVMIATHTEAAMCMPC FTTNLNMEQECRDCCGGTGRCFGPQCLCGYD" or "RCSPCFTTDQQMTKKCYDCC GGKGKGKCYGPQCICAPY" or "CGPCFTTDPYTESKCATCCGGRGKCVGPQCLCN RI" or "TEAMCMPCFTTDHNMAKKCRDCCGGNGKCFGYQCLCNRG" or "MKF
  MOD_RES (21)..(89): CONT. FROM ABOVE: LYGIVFIALFLTVMFATQTDGCGPCFTTDANMARKCRE CCGGIGKCFGPQCLCNRI" or "MKFLYGIVFIALFLTVMFATQTDGCGPCFTTDA NMARKCRECCGGNGKCFGPQCLCNRE" or "MKFLYGTILIAFFLTVMIATHSEAR CPPCFTTNPNMEADCRKCCGGRGYCASYQCICPGG" or "TEAMCMPCFTTRPDM
  MOD_RES (21)..(89): CONT. FROM ABOVE: AQQCRDCCGGNGKCFGYQCLCNRG" or "MKFLYGIV [sequence omitted]" or "MKFLYGIVFIALFLTVMIATHTEAMCMPCFTTRPDMAQQCRDCCGGNGKCFGYQCL CNRG" or "MKFLYGIILIALFLTVMIATHSEARCPNCFTTNPNAEADCKKCCGN
  MOD_RES (21)..(89): CONT. FROM ABOVE: RWGKCAGYQCVCPMK" or "MKFLYGIVFIALFLTGM [sequence omitted]" or "M CMPCFTTRPGMAQQCRDCCGGNGKCFGYQCLCNR" or "MCIPCFTTNPNMAAKCN ACCGSRRGSCRGPQCICR" or "MCIPCFTTNPNMAAKCNACCGSRRGSCRGPQC
  MOD_RES (21)..(89): CONT. FROM ABOVE: ICN" or "MCIPCFTTNPNMAAKCNACCGGNGSCRGP QCICN" or "MCIPCFTTNPNMAAKCNACCGSRGRGSCRGPQCICN" or "MCIP CFTTNPNMAAKCNACCGSRGRGKCRGPQCICN" or "MCIPCFTTDHQMAAKCNAC CGSRRGSCRGPQCICN" or "MCIPCFTTNHQMAAKCNACCGSRRGSCRGPQCIC
  MOD_RES (21)..(89): CONT. FROM ABOVE: N" or "MCIPCFTTNPNMARKCNACCGSRGRGSCRGP QCICN" or "MCIPCFTTNPNMAAKCNACCGGKGRGSCRGPQCICN" or "MCIP CFTTNPNMAAKCNACCGSRRGSCFGPQCICN" or "MCIPCFTTNPNMAAKCNACC GSRGRGKCFGPQCICN" or "MCIPCFTTNPNMAAKCNACCGSRGRGSCFGPQCI
  MOD_RES (21)..(89): CONT. FROM ABOVE: CN" or "MCIPCFTTNPNMAAKCNACCGSRGRGSCYG PQCICN" or "MCIPCFTTNPNMAAKCDACCGSRRGSCRGPQCICN" or "MCIP CFTTNHQMAAKCDACCGSRRGSCRGPQCICN" or "MCIPCFTTNHNMAAKCDACC GGRGRGSCRGPQCICN" or "MCIPCFTTNPNMAAKCDACCGSRGRGSCRGPQCI
  MOD_RES (21)..(89): CONT. FROM ABOVE: CN" or "MCIPCFTTNPNMAAKCDACCGGKGRGSCRG PQCICN" or "MCIPCFTTNHNMAAKCDACCGSRGRGSCRGPQCICN" or "MCI PCFTTNPNMAAKCRDCCGGRGSCRGPQCICN" or "MCMPCFTTNPNMAAKCDDCC GSRGRGSCRGPQCICN" or "MCIPCFTTNPNMAARCNACCGSRRGSCRGPQCIC
  MOD_RES (21)..(89): CONT. FROM ABOVE: " or "MCIPCFTTNPNMAAKCNACCGSRRGSCRGPQC ICI" or "MCMPCFTTDHQMARACDDCCGGKGRGKCYGPQCLCR" or "MCMPCF TTDHQMARRCDDCCGGKGRGKCYGPQCLCR" or "MCMPCFTTDHQMARKCDDCCG GAGRGKCYGPQCLCR" or "MCMPCFTTDHQMARACDDCCGGAGRGKCYGPQCLC
  MOD_RES (21)..(89): CONT. FROM ABOVE: R" or "MCMPCFTTDHQMARRCDDCCGGAGRGKCYGP QCLCR" or "MCMPCFTTDHQMARKCDDCCGGRGRGKCYGPQCLCR" or "MCMP CFTTDHQMARACDDCCGGRGRGKCYGPQCLCR" or "MCMPCFTTDHQMARKCDDC CGGKGRGACYGPQCLCR" or "MCMPCFTTDHQMARACDDCCGGKGRGACYGPQC
  MOD_RES (21)..(89): CONT. FROM ABOVE: LCR" or "MCMPCFTTDHQMARRCDDCCGGKGRGACY GPQCLCR" or "MCMPCFTTDHQMARKCDDCCGGAGRGACYGPQCLCR" or "MC MPCFTTDHQMARACDDCCGGAGRGACYGPQCLCR" or "MCMPCFTTDHQMARRCD DCCGGAGRGACYGPQCLCR" or "MCMPCFTTDHQMARKCDDCCGGRGRGACYGP
  MOD_RES (21)..(89): CONT. FROM ABOVE: QCLCR" or "MCMPCFTTDHQMARACDDCCGGRGRGA CYGPQCLCR" or "MCMPCFTTDHQMARRCDDCCGGRGRGACYGPQCLCR" or " MCMPCFTTDHQMARKCDDCCGGKGRGRCYGPQCLCR" or "MCMPCFTTDHQMARA CDDCCGGKGRGRCYGPQCLCR" or "MCMPCFTTDHQMARKCDDCCGGAGRGRCY
  MOD_RES (21)..(89): CONT. FROM ABOVE: GPQCLCR" or "MCMPCFTTDHQMARACDDCCGGAGR GRCYGPQCLCR" or "MCMPCFTTDHQMARRCDDCCGGAGRGRCYGPQCLCR" or "MCMPCFTTDHQMARACDDCCGGRGRGRCYGPQCLCR" or "KCMPCFTTDHQMA RRCDDCCGGRGRGRCYGPQCLCR" or "ACAPCFTTDHQAARRCDDCCGGRGRGR
  MOD_RES (21)..(89): CONT. FROM ABOVE: CYGPQCLCR" or "KCAPCFTTDHQAARRCDDCCGGR GRGRCYGPQCLCR" or "MCMPCFTTDHQMARCDDCCGGGRGKCYGPQCLCR" or "MCMPCFTTDHQMARCDDCCGGGRGCYGPQCLCR" or "KCMPCFTTDHQMARCD DCCGGGRGCYGPQCLCR" or "ACAPCFTTDHQAARCDDCCGGGRGKCYGPQCLC
  MOD_RES (21)..(89): CONT. FROM ABOVE: R" or "ACAPCFTTDHQAARCDDCCGGGRGCYGPQCL CR" or "KCAPCFTTDHQAARCDDCCGGGRGCYGPQCLCR" or "MCMPCFTTDH QMARKCDDCCGGKGRGKCYGPQCLCRGAGAAGG" or "MCMPCFTTDHQMARACDD CCGGKGRGKCYGPQCLCRGAGAAGG" or "MCMPCFTTDHQMARRCDDCCGGKGR
  MOD_RES (21)..(89): CONT. FROM ABOVE: GKCYGPQCLCRGAGAAGG" or "MCMPCFTTDHQMAR KCDDCCGGAGRGKCYGPQCLCRGAGAAGG" or "MCMPCFTTDHQMARACDDCCGG AGRGKCYGPQCLCRGAGAAGG" or "MCMPCFTTDHQMARRCDDCCGGAGRGKCYG PQCLCRGAGAAGG" or "MCMPCFTTDHQMARKCDDCCGGRGRGKCYGPQCLCRG
  MOD_RES (21)..(89): CONT. FROM ABOVE: AGAAGG" or "MCMPCFTTDHQMARACDDCCGGRGRG KCYGPQCLCRGAGAAGG" or "MCMPCFTTDHQMARRCDDCCGGRGRGKCYGPQCL CRGAGAAGG" or "MCMPCFTTDHQMARKCDDCCGGKGRGACYGPQCLCRGAGAAG G" or "MCMPCFTTDHQMARACDDCCGGKGRGACYGPQCLCRGAGAAGG" or "
  MOD_RES (21)..(89): CONT. FROM ABOVE: MCMPCFTTDHQMARRCDDCCGGKGRGACYGPQCLCRGA GAAGG" or "MCMPCFTTDHQMARKCDDCCGGAGRGACYGPQCLCRGAGAAGG" o r "MCMPCFTTDHQMARACDDCCGGAGRGACYGPQCLCRGAGAAGG" or "MCMPC FTTDHQMARRCDDCCGGAGRGACYGPQCLCRGAGAAGG" or "MCMPCFTTDHQM
  MOD_RES (21)..(89): CONT. FROM ABOVE: ARKCDDCCGGRGRGACYGPQCLCRGAGAAGG" or "M CMPCFTTDHQMARACDDCCGGRGRGACYGPQCLCRGAGAAGG" or "MCMPCFTTD HQMARRCDDCCGGRGRGACYGPQCLCRGAGAAGG" or "MCMPCFTTDHQMARKCD DCCGGKGRGRCYGPQCLCRGAGAAGG" or "MCMPCFTTDHQMARACDDCCGGKG
  MOD_RES (21)..(89): CONT. FROM ABOVE: RGRCYGPQCLCRGAGAAGG" or "MCMPCFTTDHQMA RRCDDCCGGKGRGRCYGPQCLCRGAGAAGG" or "MCMPCFTTDHQMARKCDDCCG GAGRGRCYGPQCLCRGAGAAGG" or "MCMPCFTTDHQMARACDDCCGGAGRGRCY GPQCLCRGAGAAGG" or "MCMPCFTTDHQMARRCDDCCGGAGRGRCYGPQCLCR
  MOD_RES (21)..(89): CONT. FROM ABOVE: GAGAAGG" or "MCMPCFTTDHQMARKCDDCCGGRGR GRCYGPQCLCRGAGAAGG" or "MCMPCFTTDHQMARACDDCCGGRGRGRCYGPQC LCRGAGAAGG" or "MCMPCFTTDHQMARRCDDCCGGRGRGRCYGPQCLCRGAGAA GG" or "KCMPCFTTDHQMARRCDDCCGGRGRGRCYGPQCLCRGAGAAGG" or
  MOD_RES (21)..(89): CONT. FROM ABOVE: "ACAPCFTTDHQAARRCDDCCGGRGRGRCYGPQCLCRG AGAAGG" or "KCAPCFTTDHQAARRCDDCCGGRGRGRCYGPQCLCRGAGAAGG" or "MCMPCFTTDHQMARCDDCCGGGRGKCYGPQCLCRGAGAAGG" or "MCMPCF TTDHQMARCDDCCGGGRGCYGPQCLCRGAGAAGG" or "KCMPCFTTDHQMARCD
  MOD_RES (21)..(89): CONT. FROM ABOVE: DCCGGGRGCYGPQCLCRGAGAAGG" or "ACAPCFTT DHQAARCDDCCGGGRGKCYGPQCLCRGAGAAGG" or "ACAPCFTTDHQAARCDDC CGGGRGCYGPQCLCRGAGAAGG" or "KCAPCFTTDHQAARCDDCCGGGRGCYGPQ CLCRGAGAAGG" or "MCMPCFTTDHQMVRKCDDCCGGKGRGKCYGPQCLCR" o
  MOD_RES (21)..(89): CONT. FROM ABOVE: r "MCMPCFTTDHQMVRVCDDCCGGKGRGKCYGPQCLC R" or "MCMPCFTTDHQMVRRCDDCCGGKGRGKCYGPQCLCR" or "MCMPCFTT DHQMVRKCDDCCGGVGRGKCYGPQCLCR" or "MCMPCFTTDHQMVRVCDDCCGGV GRGKCYGPQCLCR" or "MCMPCFTTDHQMVRRCDDCCGGVGRGKCYGPQCLCR"
  MOD_RES (21)..(89): CONT. FROM ABOVE:  or "MCMPCFTTDHQMVRKCDDCCGGRGRGKCYGPQC LCR" or "MCMPCFTTDHQMVRVCDDCCGGRGRGKCYGPQCLCR" or "MCMPCF TTDHQMVRRCDDCCGGRGRGKCYGPQCLCR" or "MCMPCFTTDHQMVRKCDDCCG GKGRGVCYGPQCLCR" or "MCMPCFTTDHQMVRVCDDCCGGKGRGVCYGPQCLC
  MOD_RES (21)..(89): CONT. FROM ABOVE: R" or "MCMPCFTTDHQMVRRCDDCCGGKGRGVCYGP QCLCR" or "MCMPCFTTDHQMVRKCDDCCGGVGRGVCYGPQCLCR" or "MCMP CFTTDHQMVRVCDDCCGGVGRGVCYGPQCLCR" or "MCMPCFTTDHQMVRRCDDC CGGVGRGVCYGPQCLCR" or "MCMPCFTTDHQMVRKCDDCCGGRGRGVCYGPQC
  MOD_RES (21)..(89): CONT. FROM ABOVE: LCR" or "MCMPCFTTDHQMVRVCDDCCGGRGRGVCY GPQCLCR" or "MCMPCFTTDHQMVRRCDDCCGGRGRGVCYGPQCLCR" or "MC MPCFTTDHQMVRKCDDCCGGKGRGRCYGPQCLCR" or "MCMPCFTTDHQMVRVCD DCCGGKGRGRCYGPQCLCR" or "MCMPCFTTDHQMVRRCDDCCGGKGRGRCYGP
  MOD_RES (21)..(89): CONT. FROM ABOVE: QCLCR" or "MCMPCFTTDHQMVRKCDDCCGGVGRGR CYGPQCLCR" or "MCMPCFTTDHQMVRVCDDCCGGVGRGRCYGPQCLCR" or " MCMPCFTTDHQMVRRCDDCCGGVGRGRCYGPQCLCR" or "MCMPCFTTDHQMVRK CDDCCGGRGRGRCYGPQCLCR" or "MCMPCFTTDHQMVRVCDDCCGGRGRGRCY
  MOD_RES (21)..(89): CONT. FROM ABOVE: GPQCLCR" or "MCMPCFTTDHQMVRRCDDCCGGRGR GRCYGPQCLCR" or "KCMPCFTTDHQMVRRCDDCCGGRGRGRCYGPQCLCR" or "VCVPCFTTDHQVVRRCDDCCGGRGRGRCYGPQCLCR" or "KCVPCFTTDHQVV RRCDDCCGGRGRGRCYGPQCLCR" or "MCMPCFTTDHQMVRCDDCCGGGRGKCY
  MOD_RES (21)..(89): CONT. FROM ABOVE: GPQCLCR" or "MCMPCFTTDHQMVRCDDCCGGGRGC YGPQCLCR" or "KCMPCFTTDHQMVRCDDCCGGGRGCYGPQCLCR" or "VCVP CFTTDHQVVRCDDCCGGGRGKCYGPQCLCR" or "VCVPCFTTDHQVVRCDDCCGG GRGCYGPQCLCR" or "KCVPCFTTDHQVVRCDDCCGGGRGCYGPQCLCR" or
  MOD_RES (21)..(89): CONT. FROM ABOVE: "MCMPCFTTDHQMVRKCDDCCGGKGRGKCYGPQCLCRG AGAAGG" or "MCMPCFTTDHQMVRVCDDCCGGKGRGKCYGPQCLCRGAGAAGG" or "MCMPCFTTDHQMVRRCDDCCGGKGRGKCYGPQCLCRGAGAAGG" or "MCMP CFTTDHQMVRKCDDCCGGVGRGKCYGPQCLCRGAGAAGG" or "MCMPCFTTDHQ
  MOD_RES (21)..(89): CONT. FROM ABOVE: MVRVCDDCCGGVGRGKCYGPQCLCRGAGAAGG" or " MCMPCFTTDHQMVRRCDDCCGGVGRGKCYGPQCLCRGAGAAGG" or "MCMPCFTT DHQMVRKCDDCCGGRGRGKCYGPQCLCRGAGAAGG" or "MCMPCFTTDHQMVRVC DDCCGGRGRGKCYGPQCLCRGAGAAGG" or "MCMPCFTTDHQMVRRCDDCCGGR
  MOD_RES (21)..(89): CONT. FROM ABOVE: GRGKCYGPQCLCRGAGAAGG" or "MCMPCFTTDHQM VRKCDDCCGGKGRGVCYGPQCLCRGAGAAGG" or "MCMPCFTTDHQMVRVCDDCC GGKGRGVCYGPQCLCRGAGAAGG" or "MCMPCFTTDHQMVRRCDDCCGGKGRGVC YGPQCLCRGAGAAGG" or "MCMPCFTTDHQMVRKCDDCCGGVGRGVCYGPQCLC
  MOD_RES (21)..(89): CONT. FROM ABOVE: RGAGAAGG" or "MCMPCFTTDHQMVRVCDDCCGGVG RGVCYGPQCLCRGAGAAGG" or "MCMPCFTTDHQMVRRCDDCCGGVGRGVCYGPQ CLCRGAGAAGG" or "MCMPCFTTDHQMVRKCDDCCGGRGRGVCYGPQCLCRGAGA AGG" or "MCMPCFTTDHQMVRVCDDCCGGRGRGVCYGPQCLCRGAGAAGG" or
  MOD_RES (21)..(89): CONT. FROM ABOVE:  "MCMPCFTTDHQMVRRCDDCCGGRGRGVCYGPQCLCR GAGAAGG" or "MCMPCFTTDHQMVRKCDDCCGGKGRGRCYGPQCLCRGAGAAGG" or "MCMPCFTTDHQMVRVCDDCCGGKGRGRCYGPQCLCRGAGAAGG" or "MCM PCFTTDHQMVRRCDDCCGGKGRGRCYGPQCLCRGAGAAGG" or "MCMPCFTTDH
  MOD_RES (21)..(89): CONT. FROM ABOVE: QMVRKCDDCCGGVGRGRCYGPQCLCRGAGAAGG" or "MCMPCFTTDHQMVRVCDDCCGGVGRGRCYGPQCLCRGAGAAGG" or "MCMPCFT TDHQMVRRCDDCCGGVGRGRCYGPQCLCRGAGAAGG" or "MCMPCFTTDHQMVRK CDDCCGGRGRGRCYGPQCLCRGAGAAGG" or "MCMPCFTTDHQMVRVCDDCCGG
  MOD_RES (21)..(89): CONT. FROM ABOVE: RGRGRCYGPQCLCRGAGAAGG" or "MCMPCFTTDHQ MVRRCDDCCGGRGRGRCYGPQCLCRGAGAAGG" or "KCMPCFTTDHQMVRRCDDC CGGRGRGRCYGPQCLCRGAGAAGG" or "VCVPCFTTDHQVVRRCDDCCGGRGRGR CYGPQCLCRGAGAAGG" or "KCVPCFTTDHQVVRRCDDCCGGRGRGRCYGPQCL
  MOD_RES (21)..(89): CONT. FROM ABOVE: CRGAGAAGG" or "MCMPCFTTDHQMVRCDDCCGGGR GKCYGPQCLCRGAGAAGG" or "MCMPCFTTDHQMVRCDDCCGGGRGCYGPQCLCR GAGAAGG" or "KCMPCFTTDHQMVRCDDCCGGGRGCYGPQCLCRGAGAAGG" or "VCVPCFTTDHQVVRCDDCCGGGRGKCYGPQCLCRGAGAAGG" or "VCVPCFT
  MOD_RES (21)..(89): CONT. FROM ABOVE: TDHQVVRCDDCCGGGRGCYGPQCLCRGAGAAGG" or "KCVPCFTTDHQVVRCDDCCGGGRGCYGPQCLCRGAGAAGG" or "MCMPCFTTDH QMLRKCDDCCGGKGRGKCYGPQCLCR" or "MCMPCFTTDHQMLRLCDDCCGGKGR GKCYGPQCLCR" or "MCMPCFTTDHQMLRRCDDCCGGKGRGKCYGPQCLCR" o
  MOD_RES (21)..(89): CONT. FROM ABOVE: r "MCMPCFTTDHQMLRKCDDCCGGLGRGKCYGPQCLC R" or "MCMPCFTTDHQMLRLCDDCCGGLGRGKCYGPQCLCR" or "MCMPCFTT DHQMLRRCDDCCGGLGRGKCYGPQCLCR" or "MCMPCFTTDHQMLRKCDDCCGGR GRGKCYGPQCLCR" or "MCMPCFTTDHQMLRLCDDCCGGRGRGKCYGPQCLCR"
  MOD_RES (21)..(89): CONT. FROM ABOVE:  or "MCMPCFTTDHQMLRRCDDCCGGRGRGKCYGPQC LCR" or "MCMPCFTTDHQMLRKCDDCCGGKGRGLCYGPQCLCR" or "MCMPCF TTDHQMLRLCDDCCGGKGRGLCYGPQCLCR" or "MCMPCFTTDHQMLRRCDDCCG GKGRGLCYGPQCLCR" or "MCMPCFTTDHQMLRKCDDCCGGLGRGLCYGPQCLC
  MOD_RES (21)..(89): CONT. FROM ABOVE: R" or "MCMPCFTTDHQMLRLCDDCCGGLGRGLCYGP QCLCR" or "MCMPCFTTDHQMLRRCDDCCGGLGRGLCYGPQCLCR" or "MCMP CFTTDHQMLRKCDDCCGGRGRGLCYGPQCLCR" or "MCMPCFTTDHQMLRLCDDC CGGRGRGLCYGPQCLCR" or "MCMPCFTTDHQMLRRCDDCCGGRGRGLCYGPQC
  MOD_RES (21)..(89): CONT. FROM ABOVE: LCR" or "MCMPCFTTDHQMLRKCDDCCGGKGRGRCY GPQCLCR" or "MCMPCFTTDHQMLRLCDDCCGGKGRGRCYGPQCLCR" or "MC MPCFTTDHQMLRRCDDCCGGKGRGRCYGPQCLCR" or "MCMPCFTTDHQMLRKCD DCCGGLGRGRCYGPQCLCR" or "MCMPCFTTDHQMLRLCDDCCGGLGRGRCYGP
  MOD_RES (21)..(89): CONT. FROM ABOVE: QCLCR" or "MCMPCFTTDHQMLRRCDDCCGGLGRGR CYGPQCLCR" or "MCMPCFTTDHQMLRKCDDCCGGRGRGRCYGPQCLCR" or " MCMPCFTTDHQMLRLCDDCCGGRGRGRCYGPQCLCR" or "MCMPCFTTDHQMLRR CDDCCGGRGRGRCYGPQCLCR" or "KCMPCFTTDHQMLRRCDDCCGGRGRGRCY
  MOD_RES (21)..(89): CONT. FROM ABOVE: GPQCLCR" or "LCLPCFTTDHQLLRRCDDCCGGRGR GRCYGPQCLCR" or "KCLPCFTTDHQLLRRCDDCCGGRGRGRCYGPQCLCR" or "MCMPCFTTDHQMLRCDDCCGGGRGKCYGPQCLCR" or "MCMPCFTTDHQMLRC DDCCGGGRGCYGPQCLCR" or "KCMPCFTTDHQMLRCDDCCGGGRGCYGPQCLC
  MOD_RES (21)..(89): CONT. FROM ABOVE: R" or "LCLPCFTTDHQLLRCDDCCGGGRGKCYGPQC LCR" or "LCLPCFTTDHQLLRCDDCCGGGRGCYGPQCLCR" or "KCLPCFTTD HQLLRCDDCCGGGRGCYGPQCLCR" or "MCMPCFTTDHQMLRKCDDCCGGKGRGK CYGPQCLCRGAGAAGG" or "MCMPCFTTDHQMLRLCDDCCGGKGRGKCYGPQCL
  MOD_RES (21)..(89): CONT. FROM ABOVE: CRGAGAAGG" or "MCMPCFTTDHQMLRRCDDCCGGK GRGKCYGPQCLCRGAGAAGG" or "MCMPCFTTDHQMLRKCDDCCGGLGRGKCYGP QCLCRGAGAAGG" or "MCMPCFTTDHQMLRLCDDCCGGLGRGKCYGPQCLCRGAG AAGG" or "MCMPCFTTDHQMLRRCDDCCGGLGRGKCYGPQCLCRGAGAAGG" o
  MOD_RES (21)..(89): CONT. FROM ABOVE: r "MCMPCFTTDHQMLRKCDDCCGGRGRGKCYGPQCLC RGAGAAGG" or "MCMPCFTTDHQMLRLCDDCCGGRGRGKCYGPQCLCRGAGAAGG " or "MCMPCFTTDHQMLRRCDDCCGGRGRGKCYGPQCLCRGAGAAGG" or "MC MPCFTTDHQMLRKCDDCCGGKGRGLCYGPQCLCRGAGAAGG" or "MCMPCFTTD
  MOD_RES (21)..(89): CONT. FROM ABOVE: HQMLRLCDDCCGGKGRGLCYGPQCLCRGAGAAGG" or "MCMPCFTTDHQMLRRCDDCCGGKGRGLCYGPQCLCRGAGAAGG" or "MCMPCF TTDHQMLRKCDDCCGGLGRGLCYGPQCLCRGAGAAGG" or "MCMPCFTTDHQMLR LCDDCCGGLGRGLCYGPQCLCRGAGAAGG" or "MCMPCFTTDHQMLRRCDDCCG
  MOD_RES (21)..(89): CONT. FROM ABOVE: GLGRGLCYGPQCLCRGAGAAGG" or "MCMPCFTTDH QMLRKCDDCCGGRGRGLCYGPQCLCRGAGAAGG" or "MCMPCFTTDHQMLRLCDD CCGGRGRGLCYGPQCLCRGAGAAGG" or "MCMPCFTTDHQMLRRCDDCCGGRGRG LCYGPQCLCRGAGAAGG" or "MCMPCFTTDHQMLRKCDDCCGGKGRGRCYGPQC
  MOD_RES (21)..(89): CONT. FROM ABOVE: LCRGAGAAGG" or "MCMPCFTTDHQMLRLCDDCCGG KGRGRCYGPQCLCRGAGAAGG" or "MCMPCFTTDHQMLRRCDDCCGGKGRGRCYG PQCLCRGAGAAGG" or "MCMPCFTTDHQMLRKCDDCCGGLGRGRCYGPQCLCRGA GAAGG" or "MCMPCFTTDHQMLRLCDDCCGGLGRGRCYGPQCLCRGAGAAGG"
  MOD_RES (21)..(89): CONT. FROM ABOVE: or "MCMPCFTTDHQMLRRCDDCCGGLGRGRCYGPQCL CRGAGAAGG" or "MCMPCFTTDHQMLRKCDDCCGGRGRGRCYGPQCLCRGAGAAG G" or "MCMPCFTTDHQMLRLCDDCCGGRGRGRCYGPQCLCRGAGAAGG" or "M CMPCFTTDHQMLRRCDDCCGGRGRGRCYGPQCLCRGAGAAGG" or "KCMPCFTT
  MOD_RES (21)..(89): CONT. FROM ABOVE: DHQMLRRCDDCCGGRGRGRCYGPQCLCRGAGAAGG" o r "LCLPCFTTDHQLLRRCDDCCGGRGRGRCYGPQCLCRGAGAAGG" or "KCLPC FTTDHQLLRRCDDCCGGRGRGRCYGPQCLCRGAGAAGG" or "MCMPCFTTDHQML RCDDCCGGGRGKCYGPQCLCRGAGAAGG" or "MCMPCFTTDHQMLRCDDCCGGG
  MOD_RES (21)..(89): CONT. FROM ABOVE: RGCYGPQCLCRGAGAAGG" or "KCMPCFTTDHQMLR CDDCCGGGRGCYGPQCLCRGAGAAGG" or "LCLPCFTTDHQLLRCDDCCGGGRGK CYGPQCLCRGAGAAGG" or "LCLPCFTTDHQLLRCDDCCGGGRGCYGPQCLCRGA GAAGG" or "KCLPCFTTDHQLLRCDDCCGGGRGCYGPQCLCRGAGAAGG" or
  MOD_RES (21)..(89): CONT. FROM ABOVE: "GCGPCFTTDHQGARKCDDCCGGKGRGKCYGPQCLCR" or "GCGPCFTTDHQGARACDDCCGGKGRGKCYGPQCLCR" or "GCGPCFTTDH QGARRCDDCCGGKGRGKCYGPQCLCR" or "GCGPCFTTDHQGARKCDDCCGGAGR GKCYGPQCLCR" or "GCGPCFTTDHQGARACDDCCGGAGRGKCYGPQCLCR" or
  MOD_RES (21)..(89): CONT. FROM ABOVE:  "GCGPCFTTDHQGARRCDDCCGGAGRGKCYGPQCLCR " or "GCGPCFTTDHQGARKCDDCCGGRGRGKCYGPQCLCR" or "GCGPCFTTD HQGARACDDCCGGRGRGKCYGPQCLCR" or "GCGPCFTTDHQGARRCDDCCGGRG RGKCYGPQCLCR" or "GCGPCFTTDHQGARKCDDCCGGKGRGACYGPQCLCR"
  MOD_RES (21)..(89): CONT. FROM ABOVE: or "GCGPCFTTDHQGARACDDCCGGKGRGACYGPQCL CR" or "GCGPCFTTDHQGARRCDDCCGGKGRGACYGPQCLCR" or "GCGPCFT TDHQGARKCDDCCGGAGRGACYGPQCLCR" or "GCGPCFTTDHQGARACDDCCGG AGRGACYGPQCLCR" or "GCGPCFTTDHQGARRCDDCCGGAGRGACYGPQCLCR
  MOD_RES (21)..(89): CONT. FROM ABOVE: " or "GCGPCFTTDHQGARKCDDCCGGRGRGACYGPQ CLCR" or "GCGPCFTTDHQGARACDDCCGGRGRGACYGPQCLCR" or "GCGPC FTTDHQGARRCDDCCGGRGRGACYGPQCLCR" or "GCGPCFTTDHQGARKCDDCC GGKGRGRCYGPQCLCR" or "GCGPCFTTDHQGARACDDCCGGKGRGRCYGPQCL
  MOD_RES (21)..(89): CONT. FROM ABOVE: CR" or "GCGPCFTTDHQGARRCDDCCGGKGRGRCYG PQCLCR" or "GCGPCFTTDHQGARKCDDCCGGAGRGRCYGPQCLCR" or "GCG PCFTTDHQGARACDDCCGGAGRGRCYGPQCLCR" or "GCGPCFTTDHQGARRCDD CCGGAGRGRCYGPQCLCR" or "GCGPCFTTDHQGARKCDDCCGGRGRGRCYGPQ
  MOD_RES (21)..(89): CONT. FROM ABOVE: CLCR" or "GCGPCFTTDHQGARACDDCCGGRGRGRC YGPQCLCR" or "GCGPCFTTDHQGARRCDDCCGGRGRGRCYGPQCLCR" or "K CGPCFTTDHQGARRCDDCCGGRGRGRCYGPQCLCR" or "GCGPCFTTDHQGARCD DCCGGGRGKCYGPQCLCR" or "GCGPCFTTDHQGARCDDCCGGGRGCYGPQCLC
  MOD_RES (21)..(89): CONT. FROM ABOVE: R" or "KCGPCFTTDHQGARCDDCCGGGRGCYGPQCL CR" or "ACAPCFTTDHQAARACDDCCGGKGRGKCYGPQCLCR" or "ACAPCFT TDHQAARRCDDCCGGKGRGKCYGPQCLCR" or "ACAPCFTTDHQAARKCDDCCGG AGRGKCYGPQCLCR" or "ACAPCFTTDHQAARACDDCCGGAGRGKCYGPQCLCR
  MOD_RES (21)..(89): CONT. FROM ABOVE: " or "ACAPCFTTDHQAARRCDDCCGGAGRGKCYGPQ CLCR" or "ACAPCFTTDHQAARKCDDCCGGRGRGKCYGPQCLCR" or "ACAPC FTTDHQAARACDDCCGGRGRGKCYGPQCLCR" or "ACAPCFTTDHQAARKCDDCC GGKGRGACYGPQCLCR" or "ACAPCFTTDHQAARACDDCCGGKGRGACYGPQCL
  MOD_RES (21)..(89): CONT. FROM ABOVE: CR" or "ACAPCFTTDHQAARRCDDCCGGKGRGACYG PQCLCR" or "ACAPCFTTDHQAARKCDDCCGGAGRGACYGPQCLCR" or "ACA PCFTTDHQAARACDDCCGGAGRGACYGPQCLCR" or "ACAPCFTTDHQAARRCDD CCGGAGRGACYGPQCLCR" or "ACAPCFTTDHQAARKCDDCCGGRGRGACYGPQ
  MOD_RES (21)..(89): CONT. FROM ABOVE: CLCR" or "ACAPCFTTDHQAARACDDCCGGRGRGAC YGPQCLCR" or "ACAPCFTTDHQAARRCDDCCGGRGRGACYGPQCLCR" or "A CAPCFTTDHQAARKCDDCCGGKGRGRCYGPQCLCR" or "ACAPCFTTDHQAARAC DDCCGGKGRGRCYGPQCLCR" or "ACAPCFTTDHQAARRCDDCCGGKGRGRCYG
  MOD_RES (21)..(89): CONT. FROM ABOVE: PQCLCR" or "ACAPCFTTDHQAARKCDDCCGGAGRG RCYGPQCLCR" or "ACAPCFTTDHQAARACDDCCGGAGRGRCYGPQCLCR" or "ACAPCFTTDHQAARRCDDCCGGAGRGRCYGPQCLCR" or "ACAPCFTTDHQAAR KCDDCCGGRGRGRCYGPQCLCR" or "ACAPCFTTDHQAARACDDCCGGRGRGRC
  MOD_RES (21)..(89): CONT. FROM ABOVE: YGPQCLCR" or "ICIPCFTTDHQIARKCDDCCGGKG RGKCYGPQCLCR" or "ICIPCFTTDHQIARACDDCCGGKGRGKCYGPQCLCR" o r "ICIPCFTTDHQIARRCDDCCGGKGRGKCYGPQCLCR" or "ICIPCFTTDHQI ARKCDDCCGGAGRGKCYGPQCLCR" or "ICIPCFTTDHQIARACDDCCGGAGRG
  MOD_RES (21)..(89): CONT. FROM ABOVE: KCYGPQCLCR" or "ICIPCFTTDHQIARRCDDCCGG AGRGKCYGPQCLCR" or "ICIPCFTTDHQIARKCDDCCGGRGRGKCYGPQCLCR" or "ICIPCFTTDHQIARACDDCCGGRGRGKCYGPQCLCR" or "ICIPCFTTDH QIARKCDDCCGGKGRGACYGPQCLCR" or "ICIPCFTTDHQIARACDDCCGGKG
  MOD_RES (21)..(89): CONT. FROM ABOVE: RGACYGPQCLCR" or "ICIPCFTTDHQIARRCDDCC GGKGRGACYGPQCLCR" or "ICIPCFTTDHQIARKCDDCCGGAGRGACYGPQCLC R" or "ICIPCFTTDHQIARACDDCCGGAGRGACYGPQCLCR" or "ICIPCFTT DHQIARRCDDCCGGAGRGACYGPQCLCR" or "ICIPCFTTDHQIARKCDDCCGG
  MOD_RES (21)..(89): CONT. FROM ABOVE: RGRGACYGPQCLCR" or "ICIPCFTTDHQIARACDD CCGGRGRGACYGPQCLCR" or "ICIPCFTTDHQIARRCDDCCGGRGRGACYGPQC LCR" or "ICIPCFTTDHQIARKCDDCCGGKGRGRCYGPQCLCR" or "ICIPCF TTDHQIARACDDCCGGKGRGRCYGPQCLCR" or "ICIPCFTTDHQIARRCDDCC
  MOD_RES (21)..(89): CONT. FROM ABOVE: GGKGRGRCYGPQCLCR" or "ICIPCFTTDHQIARKC DDCCGGAGRGRCYGPQCLCR" or "ICIPCFTTDHQIARACDDCCGGAGRGRCYGP QCLCR" or "ICIPCFTTDHQIARRCDDCCGGAGRGRCYGPQCLCR" or "ICIP CFTTDHQIARKCDDCCGGRGRGRCYGPQCLCR" or "ICIPCFTTDHQIARACDD
  MOD_RES (21)..(89): CONT. FROM ABOVE: CCGGRGRGRCYGPQCLCR" or "ICIPCFTTDHQIAR RCDDCCGGRGRGRCYGPQCLCR" or "KCIPCFTTDHQIARRCDDCCGGRGRGRCY GPQCLCR" or "ICIPCFTTDHQIARCDDCCGGGRGKCYGPQCLCR" or "ICIP CFTTDHQIARCDDCCGGGRGCYGPQCLCR" or "KCIPCFTTDHQIARCDDCCGG
  MOD_RES (21)..(89): CONT. FROM ABOVE: GRGCYGPQCLCR" or "TCTPCFTTDHQTARKCDDCC GGKGRGKCYGPQCLCR" or "TCTPCFTTDHQTARACDDCCGGKGRGKCYGPQCLC R" or "TCTPCFTTDHQTARRCDDCCGGKGRGKCYGPQCLCR" or "TCTPCFTT DHQTARKCDDCCGGAGRGKCYGPQCLCR" or "TCTPCFTTDHQTARACDDCCGG
  MOD_RES (21)..(89): CONT. FROM ABOVE: AGRGKCYGPQCLCR" or "TCTPCFTTDHQTARRCDD CCGGAGRGKCYGPQCLCR" or "TCTPCFTTDHQTARKCDDCCGGRGRGKCYGPQC LCR" or "TCTPCFTTDHQTARACDDCCGGRGRGKCYGPQCLCR" or "TCTPCF TTDHQTARRCDDCCGGRGRGKCYGPQCLCR" or "TCTPCFTTDHQTARKCDDCC
  MOD_RES (21)..(89): CONT. FROM ABOVE: GGKGRGACYGPQCLCR" or "TCTPCFTTDHQTARAC DDCCGGKGRGACYGPQCLCR" or "TCTPCFTTDHQTARRCDDCCGGKGRGACYGP QCLCR" or "TCTPCFTTDHQTARKCDDCCGGAGRGACYGPQCLCR" or "TCTP CFTTDHQTARACDDCCGGAGRGACYGPQCLCR" or "TCTPCFTTDHQTARRCDD
  MOD_RES (21)..(89): CONT. FROM ABOVE: CCGGAGRGACYGPQCLCR" or "TCTPCFTTDHQTAR KCDDCCGGRGRGACYGPQCLCR" or "TCTPCFTTDHQTARACDDCCGGRGRGACY GPQCLCR" or "TCTPCFTTDHQTARRCDDCCGGRGRGACYGPQCLCR" or "TC TPCFTTDHQTARKCDDCCGGKGRGRCYGPQCLCR" or "TCTPCFTTDHQTARAC
  MOD_RES (21)..(89): CONT. FROM ABOVE: DDCCGGKGRGRCYGPQCLCR" or "TCTPCFTTDHQT ARRCDDCCGGKGRGRCYGPQCLCR" or "TCTPCFTTDHQTARKCDDCCGGAGRGR CYGPQCLCR" or "TCTPCFTTDHQTARACDDCCGGAGRGRCYGPQCLCR" or " TCTPCFTTDHQTARRCDDCCGGAGRGRCYGPQCLCR" or "TCTPCFTTDHQTAR
  MOD_RES (21)..(89): CONT. FROM ABOVE: KCDDCCGGRGRGRCYGPQCLCR" or "TCTPCFTTDH QTARACDDCCGGRGRGRCYGPQCLCR" or "TCTPCFTTDHQTARRCDDCCGGRGR GRCYGPQCLCR" or "KCTPCFTTDHQTARRCDDCCGGRGRGRCYGPQCLCR" or "TCTPCFTTDHQTARCDDCCGGGRGKCYGPQCLCR" or "TCTPCFTTDHQTAR
  MOD_RES (21)..(89): CONT. FROM ABOVE: CDDCCGGGRGCYGPQCLCR" or "KCTPCFTTDHQTA RCDDCCGGGRGCYGPQCLCR" or "VCVPCFTTDHQVARKCDDCCGGKGRGKCYGP QCLCR" or "VCVPCFTTDHQVARACDDCCGGKGRGKCYGPQCLCR" or "VCVP CFTTDHQVARRCDDCCGGKGRGKCYGPQCLCR" or "VCVPCFTTDHQVARKCDD
  MOD_RES (21)..(89): CONT. FROM ABOVE: CCGGAGRGKCYGPQCLCR" or "VCVPCFTTDHQVAR ACDDCCGGAGRGKCYGPQCLCR" or "VCVPCFTTDHQVARRCDDCCGGAGRGKCY GPQCLCR" or "VCVPCFTTDHQVARKCDDCCGGRGRGKCYGPQCLCR" or "VC VPCFTTDHQVARACDDCCGGRGRGKCYGPQCLCR" or "VCVPCFTTDHQVARRC
  MOD_RES (21)..(89): CONT. FROM ABOVE: DDCCGGRGRGKCYGPQCLCR" or "VCVPCFTTDHQV ARKCDDCCGGKGRGACYGPQCLCR" or "VCVPCFTTDHQVARACDDCCGGKGRGA CYGPQCLCR" or "VCVPCFTTDHQVARRCDDCCGGKGRGACYGPQCLCR" or " VCVPCFTTDHQVARKCDDCCGGAGRGACYGPQCLCR" or "VCVPCFTTDHQVAR
  MOD_RES (21)..(89): CONT. FROM ABOVE: ACDDCCGGAGRGACYGPQCLCR" or "VCVPCFTTDH QVARRCDDCCGGAGRGACYGPQCLCR" or "VCVPCFTTDHQVARKCDDCCGGRGR GACYGPQCLCR" or "VCVPCFTTDHQVARACDDCCGGRGRGACYGPQCLCR" or "VCVPCFTTDHQVARRCDDCCGGRGRGACYGPQCLCR" or "VCVPCFTTDHQV
  MOD_RES (21)..(89): CONT. FROM ABOVE: ARKCDDCCGGKGRGRCYGPQCLCR" or "VCVPCFTT DHQVARACDDCCGGKGRGRCYGPQCLCR" or "VCVPCFTTDHQVARRCDDCCGGK GRGRCYGPQCLCR" or "VCVPCFTTDHQVARKCDDCCGGAGRGRCYGPQCLCR" or "VCVPCFTTDHQVARACDDCCGGAGRGRCYGPQCLCR" or "VCVPCFTTDH
  MOD_RES (21)..(89): CONT. FROM ABOVE: QVARRCDDCCGGAGRGRCYGPQCLCR" or "VCVPCF TTDHQVARKCDDCCGGRGRGRCYGPQCLCR" or "VCVPCFTTDHQVARACDDCCG GRGRGRCYGPQCLCR" or "VCVPCFTTDHQVARRCDDCCGGRGRGRCYGPQCLCR " or "KCVPCFTTDHQVARRCDDCCGGRGRGRCYGPQCLCR" or "VCVPCFTT
  MOD_RES (21)..(89): CONT. FROM ABOVE: DHQVARCDDCCGGGRGKCYGPQCLCR" or "VCVPCF TTDHQVARCDDCCGGGRGCYGPQCLCR" or "KCVPCFTTDHQVARCDDCCGGGRG CYGPQCLCR" or "LCLPCFTTDHQLARKCDDCCGGKGRGKCYGPQCLCR" or " LCLPCFTTDHQLARACDDCCGGKGRGKCYGPQCLCR" or "LCLPCFTTDHQLAR
  MOD_RES (21)..(89): CONT. FROM ABOVE: RCDDCCGGKGRGKCYGPQCLCR" or "LCLPCFTTDH QLARKCDDCCGGAGRGKCYGPQCLCR" or "LCLPCFTTDHQLARACDDCCGGAGR GKCYGPQCLCR" or "LCLPCFTTDHQLARRCDDCCGGAGRGKCYGPQCLCR" or "LCLPCFTTDHQLARKCDDCCGGRGRGKCYGPQCLCR" or "LCLPCFTTDHQL
  MOD_RES (21)..(89): CONT. FROM ABOVE: ARACDDCCGGRGRGKCYGPQCLCR" or "LCLPCFTT DHQLARRCDDCCGGRGRGKCYGPQCLCR" or "LCLPCFTTDHQLARKCDDCCGGK GRGACYGPQCLCR" or "LCLPCFTTDHQLARACDDCCGGKGRGACYGPQCLCR" or "LCLPCFTTDHQLARRCDDCCGGKGRGACYGPQCLCR" or "LCLPCFTTDH
  MOD_RES (21)..(89): CONT. FROM ABOVE: QLARKCDDCCGGAGRGACYGPQCLCR" or "LCLPCF TTDHQLARACDDCCGGAGRGACYGPQCLCR" or "LCLPCFTTDHQLARRCDDCCG GAGRGACYGPQCLCR" or "LCLPCFTTDHQLARKCDDCCGGRGRGACYGPQCLCR " or "LCLPCFTTDHQLARACDDCCGGRGRGACYGPQCLCR" or "LCLPCFTT
  MOD_RES (21)..(89): CONT. FROM ABOVE: DHQLARRCDDCCGGRGRGACYGPQCLCR" or "LCLP CFTTDHQLARKCDDCCGGKGRGRCYGPQCLCR" or "LCLPCFTTDHQLARACDDC CGGKGRGRCYGPQCLCR" or "LCLPCFTTDHQLARRCDDCCGGKGRGRCYGPQCL CR" or "LCLPCFTTDHQLARKCDDCCGGAGRGRCYGPQCLCR" or "LCLPCF
  MOD_RES (21)..(89): CONT. FROM ABOVE: TTDHQLARACDDCCGGAGRGRCYGPQCLCR" or "LC LPCFTTDHQLARRCDDCCGGAGRGRCYGPQCLCR" or "LCLPCFTTDHQLARKCD DCCGGRGRGRCYGPQCLCR" or "LCLPCFTTDHQLARACDDCCGGRGRGRCYGPQ CLCR" or "LCLPCFTTDHQLARRCDDCCGGRGRGRCYGPQCLCR" or "KCLP
  MOD_RES (21)..(89): CONT. FROM ABOVE: CFTTDHQLARRCDDCCGGRGRGRCYGPQCLCR" or " LCLPCFTTDHQLARCDDCCGGGRGKCYGPQCLCR" or "LCLPCFTTDHQLARCDD CCGGGRGCYGPQCLCR" or "KCLPCFTTDHQLARCDDCCGGGRGCYGPQCLCR" or "SCSPCFTTDHQSARKCDDCCGGKGRGKCYGPQCLCR" or "SCSPCFTTDH
  MOD_RES (21)..(89): CONT. FROM ABOVE: QSARACDDCCGGKGRGKCYGPQCLCR" or "SCSPCF TTDHQSARRCDDCCGGKGRGKCYGPQCLCR" or "SCSPCFTTDHQSARKCDDCCG GAGRGKCYGPQCLCR" or "SCSPCFTTDHQSARACDDCCGGAGRGKCYGPQCLCR " or "SCSPCFTTDHQSARRCDDCCGGAGRGKCYGPQCLCR" or "SCSPCFTT
  MOD_RES (21)..(89): CONT. FROM ABOVE: DHQSARKCDDCCGGRGRGKCYGPQCLCR" or "SCSP CFTTDHQSARACDDCCGGRGRGKCYGPQCLCR" or "SCSPCFTTDHQSARRCDDC CGGRGRGKCYGPQCLCR" or "SCSPCFTTDHQSARKCDDCCGGKGRGACYGPQCL CR" or "SCSPCFTTDHQSARACDDCCGGKGRGACYGPQCLCR" or "SCSPCF
  MOD_RES (21)..(89): CONT. FROM ABOVE: TTDHQSARRCDDCCGGKGRGACYGPQCLCR" or "SC SPCFTTDHQSARKCDDCCGGAGRGACYGPQCLCR" or "SCSPCFTTDHQSARACD DCCGGAGRGACYGPQCLCR" or "SCSPCFTTDHQSARRCDDCCGGAGRGACYGPQ CLCR" or "SCSPCFTTDHQSARKCDDCCGGRGRGACYGPQCLCR" or "SCSP
  MOD_RES (21)..(89): CONT. FROM ABOVE: CFTTDHQSARACDDCCGGRGRGACYGPQCLCR" or " SCSPCFTTDHQSARRCDDCCGGRGRGACYGPQCLCR" or "SCSPCFTTDHQSARK CDDCCGGKGRGRCYGPQCLCR" or "SCSPCFTTDHQSARACDDCCGGKGRGRCYG PQCLCR" or "SCSPCFTTDHQSARRCDDCCGGKGRGRCYGPQCLCR" or "SC
  MOD_RES (21)..(89): CONT. FROM ABOVE: SPCFTTDHQSARKCDDCCGGAGRGRCYGPQCLCR" or "SCSPCFTTDHQSARACDDCCGGAGRGRCYGPQCLCR" or "SCSPCFTTDHQSA RRCDDCCGGAGRGRCYGPQCLCR" or "SCSPCFTTDHQSARKCDDCCGGRGRGRC YGPQCLCR" or "SCSPCFTTDHQSARACDDCCGGRGRGRCYGPQCLCR" or "
  MOD_RES (21)..(89): CONT. FROM ABOVE: SCSPCFTTDHQSARRCDDCCGGRGRGRCYGPQCLCR" or "KCSPCFTTDHQSARRCDDCCGGRGRGRCYGPQCLCR" or "SCSPCFTTDHQ SARCDDCCGGGRGKCYGPQCLCR" or "SCSPCFTTDHQSARCDDCCGGGRGCYGP QCLCR" or "KCSPCFTTDHQSARCDDCCGGGRGCYGPQCLCR" or "MCMPCF
  MOD_RES (21)..(89): CONT. FROM ABOVE: TTDPNMARKCRDCCGGNGKCFGPQCLCNRG" or "MC MPCFTTDHNMAKKCRDCCGGNGKCFGYQCLCNRG" or "MCMPCFTTDHQTARRCR DCCGGRGRKCFGQCLCGYD" or "ACGPCFTTDPQMAEKCSDCCGGIGTCYGPQCL CNRL" or "MCMPCFTTRPNMAQQCRDCCRGRGKCFGPQCLCG" or "MCMPCF
  MOD_RES (21)..(89): CONT. FROM ABOVE: TTRPNMAQQCRDCCRGRGKCFGPQCLCGYD" or "MC MPCFTTNLNMEQECRDCCGGTGRCFGPQCLCG" or "GCMPCFTTDRYMARKCKEC CRGYGNCFGPQCLCNRG" or "GCGPCFTTDANMARKCRECCGGNGKCFGPQCLCN RE" or "GCGPCFTTDANMARKCRECCGGIGKCFGPQCLCNRI" or "MCMPCF
  MOD_RES (21)..(89): CONT. FROM ABOVE: TTRPDMAQQCRACCKGRGKCFGPQCLCG" or "MCIP CFTTNPNMAAKCNACCGSRRGSCRGPQCIC" or "[sequence omitted] GNGKCFGYQCLCNR" or "CGPCFTTDPYTESKCATCCGGRGKCVGPQCLCNR" o r "RCGPCFTTDPQTQAKCSECCGRKGGVCKGPQCICG" or "CGPCFTKDPETE
  MOD_RES (21)..(89): CONT. FROM ABOVE: KKCATCCGGIGRCFGPQCLCNRG" or "MCMPCFTTD HQMARRCDDCCGGRGRGKCWGPQCLCR" or "AMCMPCFTTDHNMAKKCRDCCGGN GKCFGPQCLCNRG" or "CGPCFTTDWESEKKCAECCGGIGRCFGPQCLCNRK" o r "CGPCFTTDHQTEQKCAECCGGIGKCYGPQCLCRG" or "CGPCFTTDRQMEQ
  MOD_RES (21)..(89): CONT. FROM ABOVE: KCAECCGGIGKCYGPQCLCRG" or "CGPCFTTDHQT EQKCAECCGGIGKCYGPQCLC" or "CMPCFTTDHQMARKCDDCCGGRGKCYGPQC LCRG" or "RCGPCFTTDPQTQAKCSECCGRKGGVCKGPQCICGIQ" or "RCPP CFTTNPNMEADCRKCCGGRGYCASYQCICPG" or "CGPCFTTDHNMARKCDECC
  MOD_RES (21)..(89): CONT. FROM ABOVE: GGKGRGKCFGPQCLCR" or "VCMPCFTTDQQMARKC SDCCGGKGRGKCYGPQCLCR" or "MCGPCFTTDANMARKCRECCGGIGKCFGPQC LCNRI" or "MCGPCFTTDANMAAACRECCGGIGKCFGPQCLCNRI" or "MCGP CFTTDANMARKCAECCGGIGKCFGPQCLCNRI" or "MCGPCFTTDANMARKCRE
  MOD_RES (21)..(89): CONT. FROM ABOVE: CCGGIGACFGPQCLCNRI" or "MCGPCFTTDANMAR KCRECCGGIGKCFGPQCLCNAI" or "CMPCFTTRPNMAQQCRDCCRGRGKCFGPQ CLCGYD" or "MCMPCFTTNLNMEQECRDCCGGTGRCFGPQCLCGYD" or "CMP CFTTRPNMAQQCRDCCRGRGKCFGPQCLCGYD" or "GSEISCEPGKTFKDKCNT
  MOD_RES (21)..(89): CONT. FROM ABOVE: CRCGADGKSAACTLKACPNQ" or "GSSCEPGRTFRD RCNTCRCGADGRSAACTLRACPNQ" or "GSSCEPGRTFRDRCNTCKCGADGRSAA CTLRACPNQ" or "GSSCEPGTTFRDRCNTCRCGSDGRSAACTLRACPQ" or "G SSCTPGTTFRDRCNTCRCSSNGRSAACTLRACPPGSY" or "GSSCTPGTTFRNR
  MOD_RES (21)..(89): CONT. FROM ABOVE: CNTCRCGSNGRSASCTLMACPPGSY" or "GSSCTPG ATFRNRCNTCRCGSNGRSASCTLMACPPGSY" or "GSSCQPGTTYQRGCNTCRCL EDGQTEACTLRLC" or "GSSCTPGATYREGCNICRCRSDGRSGACTRRICPVDSN " or "GSSCQPGTTFRRDCNTCVCNRDGTNAACTLRACL" or "EISCEPGKTF
  MOD_RES (21)..(89): CONT. FROM ABOVE: KDKCNTCRCGADGKSAACTLKACPNQ" or "SCEPGR TFRDRCNTCRCGADGRSAACTLRACPNQ" or "SCEPGRTFRDRCNTCKCGADGRS AACTLRACPNQ" or "SCEPGTTFRDRCNTCRCGSDGRSAACTLRACPQ" or "S CTPGTTFRDRCNTCRCSSNGRSAACTLRACPPGSY" or "SCTPGTTFRNRCNTC
  MOD_RES (21)..(89): CONT. FROM ABOVE: RCGSNGRSASCTLMACPPGSY" or "SCTPGATFRNR CNTCRCGSNGRSASCTLMACPPGSY" or "SCQPGTTYQRGCNTCRCLEDGQTEAC TLRLC" or "SCTPGATYREGCNICRCRSDGRSGACTRRICPVDSN" or "SCQP GTTFRRDCNTCVCNRDGTNAACTLRACL" or
  MOD_RES (21)..(89): CONT. FROM ABOVE: "GSMCMPCFTTDHQMARKCDDCCGGKGRGKCYGPQCLC R" or "GSACMPCFTTDHQMARKCDDCCGGKGRGKCYGPQCLCR" or "GSMCAP CFTTDHQMARKCDDCCGGKGRGKCYGPQCLCR" or "GSMCMACFTTDHQMARKC DDCCGGKGRGKCYGPQCLCR" or "GSMCMPCATTDHQMARKCDDCCGGKGRGKC
  MOD_RES (21)..(89): CONT. FROM ABOVE: YGPQCLCR" or "GSMCMPCFATDHQMARKCDDCCGG KGRGKCYGPQCLCR" or "GSMCMPCFTADHQMARKCDDCCGGKGRGKCYGPQCLC R" or "GSMCMPCFTTAHQMARKCDDCCGGKGRGKCYGPQCLCR" or "GSMCM PCFTTDAQMARKCDDCCGGKGRGKCYGPQCLCR" or "GSMCMPCFTTDHAMARK
  MOD_RES (21)..(89): CONT. FROM ABOVE: CDDCCGGKGRGKCYGPQCLCR" or "GSMCMPCFTTD HQAARKCDDCCGGKGRGKCYGPQCLCR" or "GSMCMPCFTTDHQMAAKCDDCCGG KGRGKCYGPQCLCR" or "GSMCMPCFTTDHQMARACDDCCGGKGRGKCYGPQCL CR" or "GSMCMPCFTTDHQMARKCADCCGGKGRGKCYGPQCLCR" or "GSMC
  MOD_RES (21)..(89): CONT. FROM ABOVE: MPCFTTDHQMARKCDACCGGKGRGKCYGPQCLCR" or "GSMCMPCFTTDHQMARKCDDCCAGKGRGKCYGPQCLCR" or "GSMCMPCFTTD HQMARKCDDCCGAKGRGKCYGPQCLCR" or "GSMCMPCFTTDHQMARKCDDCCG GAGRGKCYGPQCLCR" or "GSMCMPCFTTDHQMARKCDDCCGGKARGKCYGPQC
  MOD_RES (21)..(89): CONT. FROM ABOVE: LCR" or "GSMCMPCFTTDHQMARKCDDCCGGKGAGK CYGPQCLCR" or "GSMCMPCFTTDHQMARKCDDCCGGKGRGACYGPQCLCR" or "GSMCMPCFTTDHQMARKCDDCCGGKGRGKCAGPQCLCR" or "GSMCMPCFTT DHQMARKCDDCCGGKGRGKCYAPQCLCR" or "GSMCMPCFTTDHQMARKCDDCC
  MOD_RES (21)..(89): CONT. FROM ABOVE: GGKGRGKCYGAQCLCR" or "GSMCMPCFTTDHQMAR KCDDCCGGKGRGKCYGPACLCR" or "GSMCMPCFTTDHQMARKCDDCCGGKGRGK CYGPQCACR" or "GSMCMPCFTTDHQMARKCDDCCGGKGRGKCYGPQCLCA" o r "MCMPCFTTDHQMARKCDDCCGGKGRGKCYGPQCLCR" or "ACMPCFTTDHQ
  MOD_RES (21)..(89): CONT. FROM ABOVE: MARKCDDCCGGKGRGKCYGPQCLCR" or "MCAPCFT TDHQMARKCDDCCGGKGRGKCYGPQCLCR" or "MCMACFTTDHQMARKCDDCCGG KGRGKCYGPQCLCR" or "MCMPCATTDHQMARKCDDCCGGKGRGKCYGPQCLCR " or "MCMPCFATDHQMARKCDDCCGGKGRGKCYGPQCLCR" or "MCMPCFTA
  MOD_RES (21)..(89): CONT. FROM ABOVE: DHQMARKCDDCCGGKGRGKCYGPQCLCR" or "MCMP CFTTAHQMARKCDDCCGGKGRGKCYGPQCLCR" or "MCMPCFTTDAQMARKCDDC CGGKGRGKCYGPQCLCR" or "MCMPCFTTDHAMARKCDDCCGGKGRGKCYGPQC LCR" or "MCMPCFTTDHQAARKCDDCCGGKGRGKCYGPQCLCR" or "MCMPC
  MOD_RES (21)..(89): CONT. FROM ABOVE: FTTDHQMAAKCDDCCGGKGRGKCYGPQCLCR" or "M CMPCFTTDHQMARACDDCCGGKGRGKCYGPQCLCR" or "MCMPCFTTDHQMARKC ADCCGGKGRGKCYGPQCLCR" or "MCMPCFTTDHQMARKCDACCGGKGRGKCYG PQCLCR" or "MCMPCFTTDHQMARKCDDCCAGKGRGKCYGPQCLCR" or "MC
  MOD_RES (21)..(89): CONT. FROM ABOVE: MPCFTTDHQMARKCDDCCGAKGRGKCYGPQCLCR" or "MCMPCFTTDHQMARKCDDCCGGAGRGKCYGPQCLCR" or "MCMPCFTTDHQMA RKCDDCCGGKARGKCYGPQCLCR" or "MCMPCFTTDHQMARKCDDCCGGKGAGK CYGPQCLCR" or "MCMPCFTTDHQMARKCDDCCGGKGRGACYGPQCLCR" or
  MOD_RES (21)..(89): CONT. FROM ABOVE: "MCMPCFTTDHQMARKCDDCCGGKGRGKCAGPQCLCR" or "MCMPCFTTDHQMARKCDDCCGGKGRGKCYAPQCLCR" or "MCMPCFTTDH QMARKCDDCCGGKGRGKCYGAQCLCR" or "MCMPCFTTDHQMARKCDDCCGGKG RGKCYGPACLCR" or "MCMPCFTTDHQMARKCDDCCGGKGRGKCYGPQCACR"
  MOD_RES (21)..(89): CONT. FROM ABOVE: or "MCMPCFTTDHQMARKCDDCCGGKGRGKCYGPQCL CA"
  See specification as filed for detailed description of substitutions and preferred embodiments
METDTLLLWVLLLWVPGSTGXXXXXXXXXXXXXXXXXXXXXXXXXXXXXXXXXXXXXXXXXXXXXXXXXXXXXXXXXXXXXXXXXXXXXGGSGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1231 - protein, 20 aa, Artificial Sequence
  Description of Artificial Sequence: Synthetic peptide
METDTLLLWVLLLWVPGSTG

SEQ ID NO: 1232 - protein, 30 aa, Artificial Sequence
  Description of Artificial Sequence: Synthetic polypeptide
MAPRRARGCRTLGLPALLLLLLLRPPATRG

SEQ ID NO: 1233 - protein, 338 aa, Artificial Sequence; identical to SEQ ID NO: 1173
  Description of Artificial Sequence: Synthetic polypeptide
  MOD_RES (253)..(302): Any amino acid or absent

SEQ ID NO: 1234 - protein, 345 aa, Artificial Sequence; identical to SEQ ID NO: 1174
  Description of Artificial Sequence: Synthetic polypeptide
  MOD_RES (260)..(309): Any amino acid or absent

SEQ ID NO: 1235 - RNA, 12 nt, Artificial Sequence
  Description of Artificial Sequence: Synthetic oligonucleotide
accagacaagag

SEQ ID NO: 1236 - RNA, 12 nt, Artificial Sequence
  Description of Artificial Sequence: Synthetic oligonucleotide
cucuuguuuggu

SEQ ID NO: 1237 - RNA, 15 nt, Artificial Sequence
  Description of Artificial Sequence: Synthetic oligonucleotide
gagcagaaacaaggc

SEQ ID NO: 1238 - RNA, 15 nt, Artificial Sequence
  Description of Artificial Sequence: Synthetic oligonucleotide
cucgucuuuguuccg

SEQ ID NO: 1239 - RNA, 26 nt, Artificial Sequence
  Description of Artificial Sequence: Synthetic oligonucleotide
gggacgcugacccagaagaucuacua

SEQ ID NO: 1240 - RNA, 26 nt, Artificial Sequence
  Description of Artificial Sequence: Synthetic oligonucleotide
cccugcgacugggucuucuagaugau

SEQ ID NO: 1241 - RNA, 18 nt, Artificial Sequence
  Description of Artificial Sequence: Synthetic oligonucleotide
ggcaugcgaccucuguuu

SEQ ID NO: 1242 - RNA, 18 nt, Artificial Sequence
  Description of Artificial Sequence: Synthetic oligonucleotide
ccguacgcuggagacaaa

SEQ ID NO: 1243 - protein, 38 aa, Artificial Sequence
  Description of Artificial Sequence: Synthetic polypeptide
GSEISCEPGKTFKDKCNTCRCGADGKSAACTLKACPNQ

SEQ ID NO: 1244 - protein, 36 aa, Artificial Sequence
  Description of Artificial Sequence: Synthetic polypeptide
GSSCEPGRTFRDRCNTCRCGADGRSAACTLRACPNQ

SEQ ID NO: 1245 - protein, 36 aa, Artificial Sequence
  Description of Artificial Sequence: Synthetic polypeptide
GSSCEPGRTFRDRCNTCKCGADGRSAACTLRACPNQ

SEQ ID NO: 1246 - protein, 35 aa, Artificial Sequence
  Description of Artificial Sequence: Synthetic polypeptide
GSSCEPGTTFRDRCNTCRCGSDGRSAACTLRACPQ

SEQ ID NO: 1247 - protein, 38 aa, Artificial Sequence
  Description of Artificial Sequence: Synthetic polypeptide
GSSCTPGTTFRDRCNTCRCSSNGRSAACTLRACPPGSY

SEQ ID NO: 1248 - protein, 38 aa, Artificial Sequence
  Description of Artificial Sequence: Synthetic polypeptide
GSSCTPGTTFRNRCNTCRCGSNGRSASCTLMACPPGSY

SEQ ID NO: 1249 - protein, 38 aa, Artificial Sequence
  Description of Artificial Sequence: Synthetic polypeptide
GSSCTPGATFRNRCNTCRCGSNGRSASCTLMACPPGSY

SEQ ID NO: 1250 - protein, 33 aa, Artificial Sequence
  Description of Artificial Sequence: Synthetic polypeptide
GSSCQPGTTYQRGCNTCRCLEDGQTEACTLRLC

SEQ ID NO: 1251 - protein, 38 aa, Artificial Sequence
  Description of Artificial Sequence: Synthetic polypeptide
GSSCTPGATYREGCNICRCRSDGRSGACTRRICPVDSN

SEQ ID NO: 1252 - protein, 34 aa, Artificial Sequence
  Description of Artificial Sequence: Synthetic polypeptide
GSSCQPGTTFRRDCNTCVCNRDGTNAACTLRACL

SEQ ID NO: 1253 - protein, 36 aa, Artificial Sequence
  Description of Artificial Sequence: Synthetic polypeptide
EISCEPGKTFKDKCNTCRCGADGKSAACTLKACPNQ

SEQ ID NO: 1254 - protein, 34 aa, Artificial Sequence
  Description of Artificial Sequence: Synthetic polypeptide
SCEPGRTFRDRCNTCRCGADGRSAACTLRACPNQ

SEQ ID NO: 1255 - protein, 34 aa, Artificial Sequence
  Description of Artificial Sequence: Synthetic polypeptide
SCEPGRTFRDRCNTCKCGADGRSAACTLRACPNQ

SEQ ID NO: 1256 - protein, 33 aa, Artificial Sequence
  Description of Artificial Sequence: Synthetic polypeptide
SCEPGTTFRDRCNTCRCGSDGRSAACTLRACPQ

SEQ ID NO: 1257 - protein, 36 aa, Artificial Sequence
  Description of Artificial Sequence: Synthetic polypeptide
SCTPGTTFRDRCNTCRCSSNGRSAACTLRACPPGSY

SEQ ID NO: 1258 - protein, 36 aa, Artificial Sequence
  Description of Artificial Sequence: Synthetic polypeptide
SCTPGTTFRNRCNTCRCGSNGRSASCTLMACPPGSY

SEQ ID NO: 1259 - protein, 36 aa, Artificial Sequence
  Description of Artificial Sequence: Synthetic polypeptide
SCTPGATFRNRCNTCRCGSNGRSASCTLMACPPGSY

SEQ ID NO: 1260 - protein, 31 aa, Artificial Sequence
  Description of Artificial Sequence: Synthetic polypeptide
SCQPGTTYQRGCNTCRCLEDGQTEACTLRLC

SEQ ID NO: 1261 - protein, 36 aa, Artificial Sequence
  Description of Artificial Sequence: Synthetic polypeptide
SCTPGATYREGCNICRCRSDGRSGACTRRICPVDSN

SEQ ID NO: 1262 - protein, 32 aa, Artificial Sequence
  Description of Artificial Sequence: Synthetic polypeptide
SCQPGTTFRRDCNTCVCNRDGTNAACTLRACL

SEQ ID NO: 1263 - protein, 38 aa, Artificial Sequence; identical to SEQ ID NO: 1
  Description of Artificial Sequence: Synthetic polypeptide

SEQ ID NO: 1264 - protein, 38 aa, Artificial Sequence
  Description of Artificial Sequence: Synthetic polypeptide
GSACMPCFTTDHQMARKCDDCCGGKGRGKCYGPQCLCR

SEQ ID NO: 1265 - protein, 38 aa, Artificial Sequence
  Description of Artificial Sequence: Synthetic polypeptide
GSMCAPCFTTDHQMARKCDDCCGGKGRGKCYGPQCLCR

SEQ ID NO: 1266 - protein, 38 aa, Artificial Sequence
  Description of Artificial Sequence: Synthetic polypeptide
GSMCMACFTTDHQMARKCDDCCGGKGRGKCYGPQCLCR

SEQ ID NO: 1267 - protein, 38 aa, Artificial Sequence
  Description of Artificial Sequence: Synthetic polypeptide
GSMCMPCATTDHQMARKCDDCCGGKGRGKCYGPQCLCR

SEQ ID NO: 1268 - protein, 38 aa, Artificial Sequence
  Description of Artificial Sequence: Synthetic polypeptide
GSMCMPCFATDHQMARKCDDCCGGKGRGKCYGPQCLCR

SEQ ID NO: 1269 - protein, 38 aa, Artificial Sequence
  Description of Artificial Sequence: Synthetic polypeptide
GSMCMPCFTADHQMARKCDDCCGGKGRGKCYGPQCLCR

SEQ ID NO: 1270 - protein, 38 aa, Artificial Sequence
  Description of Artificial Sequence: Synthetic polypeptide
GSMCMPCFTTAHQMARKCDDCCGGKGRGKCYGPQCLCR

SEQ ID NO: 1271 - protein, 38 aa, Artificial Sequence
  Description of Artificial Sequence: Synthetic polypeptide
GSMCMPCFTTDAQMARKCDDCCGGKGRGKCYGPQCLCR

SEQ ID NO: 1272 - protein, 38 aa, Artificial Sequence
  Description of Artificial Sequence: Synthetic polypeptide
GSMCMPCFTTDHAMARKCDDCCGGKGRGKCYGPQCLCR

SEQ ID NO: 1273 - protein, 38 aa, Artificial Sequence
  Description of Artificial Sequence: Synthetic polypeptide
GSMCMPCFTTDHQAARKCDDCCGGKGRGKCYGPQCLCR

SEQ ID NO: 1274 - protein, 38 aa, Artificial Sequence
  Description of Artificial Sequence: Synthetic polypeptide
GSMCMPCFTTDHQMAAKCDDCCGGKGRGKCYGPQCLCR

SEQ ID NO: 1275 - protein, 38 aa, Artificial Sequence; identical to SEQ ID NO: 113
  Description of Artificial Sequence: Synthetic polypeptide

SEQ ID NO: 1276 - protein, 38 aa, Artificial Sequence
  Description of Artificial Sequence: Synthetic polypeptide
GSMCMPCFTTDHQMARKCADCCGGKGRGKCYGPQCLCR

SEQ ID NO: 1277 - protein, 38 aa, Artificial Sequence
  Description of Artificial Sequence: Synthetic polypeptide
GSMCMPCFTTDHQMARKCDACCGGKGRGKCYGPQCLCR

SEQ ID NO: 1278 - protein, 38 aa, Artificial Sequence
  Description of Artificial Sequence: Synthetic polypeptide
GSMCMPCFTTDHQMARKCDDCCAGKGRGKCYGPQCLCR

SEQ ID NO: 1279 - protein, 38 aa, Artificial Sequence
  Description of Artificial Sequence: Synthetic polypeptide
GSMCMPCFTTDHQMARKCDDCCGAKGRGKCYGPQCLCR

SEQ ID NO: 1280 - protein, 38 aa, Artificial Sequence; identical to SEQ ID NO: 115
  Description of Artificial Sequence: Synthetic polypeptide

SEQ ID NO: 1281 - protein, 38 aa, Artificial Sequence
  Description of Artificial Sequence: Synthetic polypeptide
GSMCMPCFTTDHQMARKCDDCCGGKARGKCYGPQCLCR

SEQ ID NO: 1282 - protein, 38 aa, Artificial Sequence
  Description of Artificial Sequence: Synthetic polypeptide
GSMCMPCFTTDHQMARKCDDCCGGKGAGKCYGPQCLCR

SEQ ID NO: 1283 - protein, 38 aa, Artificial Sequence; identical to SEQ ID NO: 120
  Description of Artificial Sequence: Synthetic polypeptide

SEQ ID NO: 1284 - protein, 38 aa, Artificial Sequence
  Description of Artificial Sequence: Synthetic polypeptide
GSMCMPCFTTDHQMARKCDDCCGGKGRGKCAGPQCLCR

SEQ ID NO: 1285 - protein, 38 aa, Artificial Sequence
  Description of Artificial Sequence: Synthetic polypeptide
GSMCMPCFTTDHQMARKCDDCCGGKGRGKCYAPQCLCR

SEQ ID NO: 1286 - protein, 38 aa, Artificial Sequence
  Description of Artificial Sequence: Synthetic polypeptide
GSMCMPCFTTDHQMARKCDDCCGGKGRGKCYGAQCLCR

SEQ ID NO: 1287 - protein, 38 aa, Artificial Sequence
  Description of Artificial Sequence: Synthetic polypeptide
GSMCMPCFTTDHQMARKCDDCCGGKGRGKCYGPACLCR

SEQ ID NO: 1288 - protein, 38 aa, Artificial Sequence
  Description of Artificial Sequence: Synthetic polypeptide
GSMCMPCFTTDHQMARKCDDCCGGKGRGKCYGPQCACR

SEQ ID NO: 1289 - protein, 38 aa, Artificial Sequence
  Description of Artificial Sequence: Synthetic polypeptide
GSMCMPCFTTDHQMARKCDDCCGGKGRGKCYGPQCLCA

SEQ ID NO: 1290 - protein, 36 aa, Artificial Sequence; identical to SEQ ID NO: 568
  Description of Artificial Sequence: Synthetic polypeptide

SEQ ID NO: 1291 - protein, 36 aa, Artificial Sequence
  Description of Artificial Sequence: Synthetic polypeptide
ACMPCFTTDHQMARKCDDCCGGKGRGKCYGPQCLCR

SEQ ID NO: 1292 - protein, 36 aa, Artificial Sequence
  Description of Artificial Sequence: Synthetic polypeptide
MCAPCFTTDHQMARKCDDCCGGKGRGKCYGPQCLCR

SEQ ID NO: 1293 - protein, 36 aa, Artificial Sequence
  Description of Artificial Sequence: Synthetic polypeptide
MCMACFTTDHQMARKCDDCCGGKGRGKCYGPQCLCR

SEQ ID NO: 1294 - protein, 36 aa, Artificial Sequence
  Description of Artificial Sequence: Synthetic polypeptide
MCMPCATTDHQMARKCDDCCGGKGRGKCYGPQCLCR

SEQ ID NO: 1295 - protein, 36 aa, Artificial Sequence
  Description of Artificial Sequence: Synthetic polypeptide
MCMPCFATDHQMARKCDDCCGGKGRGKCYGPQCLCR

SEQ ID NO: 1296 - protein, 36 aa, Artificial Sequence
  Description of Artificial Sequence: Synthetic polypeptide
MCMPCFTADHQMARKCDDCCGGKGRGKCYGPQCLCR

SEQ ID NO: 1297 - protein, 36 aa, Artificial Sequence
  Description of Artificial Sequence: Synthetic polypeptide
MCMPCFTTAHQMARKCDDCCGGKGRGKCYGPQCLCR

SEQ ID NO: 1298 - protein, 36 aa, Artificial Sequence
  Description of Artificial Sequence: Synthetic polypeptide
MCMPCFTTDAQMARKCDDCCGGKGRGKCYGPQCLCR

SEQ ID NO: 1299 - protein, 36 aa, Artificial Sequence
  Description of Artificial Sequence: Synthetic polypeptide
MCMPCFTTDHAMARKCDDCCGGKGRGKCYGPQCLCR

SEQ ID NO: 1300 - protein, 36 aa, Artificial Sequence
  Description of Artificial Sequence: Synthetic polypeptide
MCMPCFTTDHQAARKCDDCCGGKGRGKCYGPQCLCR

SEQ ID NO: 1301 - protein, 36 aa, Artificial Sequence
  Description of Artificial Sequence: Synthetic polypeptide
MCMPCFTTDHQMAAKCDDCCGGKGRGKCYGPQCLCR

SEQ ID NO: 1302 - protein, 36 aa, Artificial Sequence; identical to SEQ ID NO: 680
  Description of Artificial Sequence: Synthetic polypeptide

SEQ ID NO: 1303 - protein, 36 aa, Artificial Sequence
  Description of Artificial Sequence: Synthetic polypeptide
MCMPCFTTDHQMARKCADCCGGKGRGKCYGPQCLCR

SEQ ID NO: 1304 - protein, 36 aa, Artificial Sequence
  Description of Artificial Sequence: Synthetic polypeptide
MCMPCFTTDHQMARKCDACCGGKGRGKCYGPQCLCR

SEQ ID NO: 1305 - protein, 36 aa, Artificial Sequence
  Description of Artificial Sequence: Synthetic polypeptide
MCMPCFTTDHQMARKCDDCCAGKGRGKCYGPQCLCR

SEQ ID NO: 1306 - protein, 36 aa, Artificial Sequence
  Description of Artificial Sequence: Synthetic polypeptide
MCMPCFTTDHQMARKCDDCCGAKGRGKCYGPQCLCR

SEQ ID NO: 1307 - protein, 36 aa, Artificial Sequence; identical to SEQ ID NO: 682
  Description of Artificial Sequence: Synthetic polypeptide

SEQ ID NO: 1308 - protein, 36 aa, Artificial Sequence
  Description of Artificial Sequence: Synthetic polypeptide
MCMPCFTTDHQMARKCDDCCGGKARGKCYGPQCLCR

SEQ ID NO: 1309 - protein, 36 aa, Artificial Sequence
  Description of Artificial Sequence: Synthetic polypeptide
MCMPCFTTDHQMARKCDDCCGGKGAGKCYGPQCLCR

SEQ ID NO: 1310 - protein, 36 aa, Artificial Sequence; identical to SEQ ID NO: 687
  Description of Artificial Sequence: Synthetic polypeptide

SEQ ID NO: 1311 - protein, 36 aa, Artificial Sequence
  Description of Artificial Sequence: Synthetic polypeptide
MCMPCFTTDHQMARKCDDCCGGKGRGKCAGPQCLCR

SEQ ID NO: 1312 - protein, 36 aa, Artificial Sequence
  Description of Artificial Sequence: Synthetic polypeptide
MCMPCFTTDHQMARKCDDCCGGKGRGKCYAPQCLCR

SEQ ID NO: 1313 - protein, 36 aa, Artificial Sequence
  Description of Artificial Sequence: Synthetic polypeptide
MCMPCFTTDHQMARKCDDCCGGKGRGKCYGAQCLCR

SEQ ID NO: 1314 - protein, 36 aa, Artificial Sequence
  Description of Artificial Sequence: Synthetic polypeptide
MCMPCFTTDHQMARKCDDCCGGKGRGKCYGPACLCR

SEQ ID NO: 1315 - protein, 36 aa, Artificial Sequence
  Description of Artificial Sequence: Synthetic polypeptide
MCMPCFTTDHQMARKCDDCCGGKGRGKCYGPQCACR

SEQ ID NO: 1316 - protein, 36 aa, Artificial Sequence
  Description of Artificial Sequence: Synthetic polypeptide
MCMPCFTTDHQMARKCDDCCGGKGRGKCYGPQCLCA

SEQ ID NO: 1317 - protein, 279 aa, Artificial Sequence
  Description of Artificial Sequence: Synthetic polypeptide
HHHHHHHHHHITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSGGGGSVAGGGGSGGGGSMCMPCFTTDHQMARKCDDCCGGKGRGKCYGPQCLCR

SEQ ID NO: 1318 - protein, 285 aa, Artificial Sequence
  Description of Artificial Sequence: Synthetic polypeptide
HHHHHHHHHHNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPPGGGGSGGGGSVAGGGGSGGGGSMCMPCFTTDHQMARKCDDCCGGKGRGKCYGPQCLCR

SEQ ID NO: 1319 - protein, 283 aa, Artificial Sequence
  Description of Artificial Sequence: Synthetic polypeptide
HHHHHHHHHHITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSAEAAAKEAAAKAVAAEAAAKEAAAKAMCMPCFTTDHQMARKCDDCCGGKGRGKCYGPQCLCR

SEQ ID NO: 1320 - protein, 279 aa, Artificial Sequence
  Description of Artificial Sequence: Synthetic polypeptide
MCMPCFTTDHQMARKCDDCCGGKGRGKCYGPQCLCRGGGGSGGGGSVAGGGGSGGGGSITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSHHHHHHHHHH

SEQ ID NO: 1321 - protein, 272 aa, Artificial Sequence
  Description of Artificial Sequence: Synthetic polypeptide
HHHHHHHHHHITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSGGGGSGGGGSMCMPCFTTDHQMARKCDDCCGGKGRGKCYGPQCLCR

SEQ ID NO: 1322 - protein, 281 aa, Artificial Sequence
  Description of Artificial Sequence: Synthetic polypeptide
DYKDDDDKIEGRITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSGGGGSVAGGGGSGGGGSMCMPCFTTDHQMARKCDDCCGGKGRGKCYGPQCLCR

SEQ ID NO: 1323 - protein, 283 aa, Artificial Sequence
  Description of Artificial Sequence: Synthetic polypeptide
HHHHHHHHHHITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSGGGGSPLGLAGGGGGSGGGGSMCMPCFTTDHQMARKCDDCCGGKGRGKCYGPQCLCR

SEQ ID NO: 1324 - protein, 278 aa, Artificial Sequence
  Description of Artificial Sequence: Synthetic polypeptide
HHHHHHHHHHNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPPGGGGSGGGGSGGGGSMCMPCFTTDHQMARKCDDCCGGKGRGKCYGPQCLCR

SEQ ID NO: 1325 - protein, 274 aa, Artificial Sequence
  Description of Artificial Sequence: Synthetic polypeptide
HHHHHHHHHHITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSAEAAAKEAAAKEAAAKAMCMPCFTTDHQMARKCDDCCGGKGRGKCYGPQCLCR

SEQ ID NO: 1326 - protein, 272 aa, Artificial Sequence
  Description of Artificial Sequence: Synthetic polypeptide
HHHHHHHHHHMCMPCFTTDHQMARKCDDCCGGKGRGKCYGPQCLCRGGGGSGGGGSGGGGSITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 1327 - protein, 289 aa, Artificial Sequence
  Description of Artificial Sequence: Synthetic polypeptide
HHHHHHHHHHNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPPGGGGSGGGGSPLGLAGGGGGSGGGGSMCMPCFTTDHQMARKCDDCCGGKGRGKCYGPQCLCR

SEQ ID NO: 1328 - protein, 263 aa, Artificial Sequence
  Description of Artificial Sequence: Synthetic polypeptide
HHHHHHHHHHITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGSVAGSMCMPCFTTDHQMARRCDDCCGGRGRGKCYGPQCLCR

SEQ ID NO: 1329 - protein, 275 aa, Artificial Sequence
  Description of Artificial Sequence: Synthetic polypeptide
MCMPCFTTDHQMARRCDDCCGGRGRGKCYGPQCLCRGGGGSVAGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPPHHHHHHHHHH

SEQ ID NO: 1330 - protein, 269 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSGGGGSVAGGGGSGGGGSMCMPCFTTDHQMARKCDDCCGGKGRGKCYGPQCLCR

SEQ ID NO: 1331 - protein, 275 aa, Artificial Sequence
  Description of Artificial Sequence: Synthetic polypeptide
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPPGGGGSGGGGSVAGGGGSGGGGSMCMPCFTTDHQMARKCDDCCGGKGRGKCYGPQCLCR

SEQ ID NO: 1332 - protein, 273 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSAEAAAKEAAAKAVAAEAAAKEAAAKAMCMPCFTTDHQMARKCDDCCGGKGRGKCYGPQCLCR

SEQ ID NO: 1333 - protein, 269 aa, Artificial Sequence
  Description of Artificial Sequence: Synthetic polypeptide
MCMPCFTTDHQMARKCDDCCGGKGRGKCYGPQCLCRGGGGSGGGGSVAGGGGSGGGGSITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 1334 - protein, 262 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSGGGGSGGGGSMCMPCFTTDHQMARKCDDCCGGKGRGKCYGPQCLCR

SEQ ID NO: 1335 - protein, 273 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSGGGGSPLGLAGGGGGSGGGGSMCMPCFTTDHQMARKCDDCCGGKGRGKCYGPQCLCR

SEQ ID NO: 1336 - protein, 268 aa, Artificial Sequence
  Description of Artificial Sequence: Synthetic polypeptide
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPPGGGGSGGGGSGGGGSMCMPCFTTDHQMARKCDDCCGGKGRGKCYGPQCLCR

SEQ ID NO: 1337 - protein, 264 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSAEAAAKEAAAKEAAAKAMCMPCFTTDHQMARKCDDCCGGKGRGKCYGPQCLCR

SEQ ID NO: 1338 - protein, 262 aa, Artificial Sequence
  Description of Artificial Sequence: Synthetic polypeptide
MCMPCFTTDHQMARKCDDCCGGKGRGKCYGPQCLCRGGGGSGGGGSGGGGSITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 1339 - protein, 279 aa, Artificial Sequence
  Description of Artificial Sequence: Synthetic polypeptide
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPPGGGGSGGGGSPLGLAGGGGGSGGGGSMCMPCFTTDHQMARKCDDCCGGKGRGKCYGPQCLCR

SEQ ID NO: 1340 - protein, 253 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGSVAGSMCMPCFTTDHQMARRCDDCCGGRGRGKCYGPQCLCR

SEQ ID NO: 1341 - protein, 265 aa, Artificial Sequence
  Description of Artificial Sequence: Synthetic polypeptide
MCMPCFTTDHQMARRCDDCCGGRGRGKCYGPQCLCRGGGGSVAGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPP

SEQ ID NO: 1342 - protein, 221 aa, Artificial Sequence
  Description of Artificial Sequence: Synthetic polypeptide
HHHHHHHHHHITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 1343 - protein, 268 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRDPALVHQRPAPPGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSGGGGSVAGGGGSGGGGSMCMPCFTTDHQMARKCDDCCGGKGRGKCYGPQCLCR

SEQ ID NO: 1344 - protein, 269 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRDPALVHQRPAPPGGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSGGGGSVAGGGGSGGGGSMCMPCFTTDHQMARKCDDCCGGKGRGKCYGPQCLCR

SEQ ID NO: 1345 - protein, 269 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSGGGGSVAGGGGSGGGGSMCMPCFTTDHQMARACDDCCGGAGRGKCYGPQCLCR

SEQ ID NO: 1346 - protein, 269 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSGGGGSVAGGGGSGGGGSMCMPCFTTDHQMARRCDDCCGGRGRGKCYGPQCLCR

SEQ ID NO: 1347 - protein, 265 aa, Artificial Sequence
  Description of Artificial Sequence: Synthetic polypeptide
MCMPCFTTDHQMARKCDDCCGGKGRGKCYGPQCLCRGGGGSVAGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPP

SEQ ID NO: 1348 - protein, 265 aa, Artificial Sequence
  Description of Artificial Sequence: Synthetic polypeptide
MCMPCFTTDHQMARACDDCCGGAGRGKCYGPQCLCRGGGGSVAGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPP

SEQ ID NO: 1349 - protein, 297 aa, Artificial Sequence
  Description of Artificial Sequence: Synthetic polypeptide
  MOD_RES (212)..(261): Any amino acid or absent
ITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSXXXXXXXXXXXXXXXXXXXXXXXXXXXXXXXXXXXXXXXXXXXXXXXXXXMCMPCFTTDHQMARKCDDCCGGKGRGKCYGPQCLCR

SEQ ID NO: 1350 - protein, 303 aa, Artificial Sequence
  Description of Artificial Sequence: Synthetic polypeptide
  MOD_RES (218)..(267): Any amino acid or absent
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPPXXXXXXXXXXXXXXXXXXXXXXXXXXXXXXXXXXXXXXXXXXXXXXXXXXMCMPCFTTDHQMARKCDDCCGGKGRGKCYGPQCLCR

SEQ ID NO: 1351 - protein, 275 aa, Artificial Sequence
  Description of Artificial Sequence: Synthetic polypeptide
  MOD_RES (212)..(239): Any amino acid or absent
ITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSXXXXXXXXXXXXXXXXXXXXXXXXXXXXMCMPCFTTDHQMARKCDDCCGGKGRGKCYGPQCLCR

SEQ ID NO: 1352 - protein, 283 aa, Artificial Sequence
  Description of Artificial Sequence: Synthetic polypeptide
  MOD_RES (218)..(247): Any amino acid or absent
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPPXXXXXXXXXXXXXXXXXXXXXXXXXXXXXXMCMPCFTTDHQMARKCDDCCGGKGRGKCYGPQCLCR

SEQ ID NO: 1353 - protein, 297 aa, Artificial Sequence
  Description of Artificial Sequence: Synthetic polypeptide
  MOD_RES (212)..(261): Any amino acid or absent
ITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSXXXXXXXXXXXXXXXXXXXXXXXXXXXXXXXXXXXXXXXXXXXXXXXXXXMCMPCFTTDHQMARACDDCCGGAGRGKCYGPQCLCR

SEQ ID NO: 1354 - protein, 303 aa, Artificial Sequence
  Description of Artificial Sequence: Synthetic polypeptide
  MOD_RES (218)..(267): Any amino acid or absent
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPPXXXXXXXXXXXXXXXXXXXXXXXXXXXXXXXXXXXXXXXXXXXXXXXXXXMCMPCFTTDHQMARACDDCCGGAGRGKCYGPQCLCR

SEQ ID NO: 1355 - protein, 297 aa, Artificial Sequence
  Description of Artificial Sequence: Synthetic polypeptide
  MOD_RES (212)..(261): Any amino acid or absent
ITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSXXXXXXXXXXXXXXXXXXXXXXXXXXXXXXXXXXXXXXXXXXXXXXXXXXMCMPCFTTDHQMARRCDDCCGGRGRGKCYGPQCLCR

SEQ ID NO: 1356 - protein, 303 aa, Artificial Sequence
  Description of Artificial Sequence: Synthetic polypeptide
  MOD_RES (218)..(267): Any amino acid or absent
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPPXXXXXXXXXXXXXXXXXXXXXXXXXXXXXXXXXXXXXXXXXXXXXXXXXXMCMPCFTTDHQMARRCDDCCGGRGRGKCYGPQCLCR

SEQ ID NO: 1357 - protein, 327 aa, Artificial Sequence
  Description of Artificial Sequence: Synthetic polypeptide
  MOD_RES (78)..(127): Any amino acid or absent
  MOD_RES (242)..(291): Any amino acid or absent
ITCPPPMSVEHADIWVKSYSLYSRERYICNSGFKRKAGTSSLTECVLNKATNVAHWTTPSLKCIRDPALVHQRPAPPXXXXXXXXXXXXXXXXXXXXXXXXXXXXXXXXXXXXXXXXXXXXXXXXXXNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSXXXXXXXXXXXXXXXXXXXXXXXXXXXXXXXXXXXXXXXXXXXXXXXXXXMCMPCFTTDHQMARRCDDCCGGRGRGKCYGPQCLCR

SEQ ID NO: 1358 - protein, 327 aa, Artificial Sequence
  Description of Artificial Sequence: Synthetic polypeptide
  MOD_RES (115)..(164): Any amino acid or absent
  MOD_RES (242)..(291): Any amino acid or absent
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSXXXXXXXXXXXXXXXXXXXXXXXXXXXXXXXXXXXXXXXXXXXXXXXXXXITCPPPMSVEHADIWVKSYSLYSRERYICNSGFKRKAGTSSLTECVLNKATNVAHWTTPSLKCIRDPALVHQRPAPPXXXXXXXXXXXXXXXXXXXXXXXXXXXXXXXXXXXXXXXXXXXXXXXXXXMCMPCFTTDHQMARRCDDCCGGRGRGKCYGPQCLCR

SEQ ID NO: 1359 - protein, 15 aa, Artificial Sequence
  Description of Artificial Sequence: Synthetic peptide
GGGGSGGGGSGGGGS

SEQ ID NO: 1360 - protein, 6 aa, Artificial Sequence
  Description of Artificial Sequence: Synthetic peptide
GSVAGS

SEQ ID NO: 1361 - protein, 12 aa, Artificial Sequence
  Description of Artificial Sequence: Synthetic peptide
GGGGSVAGGGGS

SEQ ID NO: 1362 - protein, 22 aa, Artificial Sequence
  Description of Artificial Sequence: Synthetic peptide
GGGGSGGGGSVAGGGGSGGGGS

SEQ ID NO: 1363 - protein, 26 aa, Artificial Sequence
  Description of Artificial Sequence: Synthetic peptide
GGGGSGGGGSPLGLAGGGGGSGGGGS

SEQ ID NO: 1364 - protein, 17 aa, Artificial Sequence
  Description of Artificial Sequence: Synthetic peptide
AEAAAKEAAAKEAAAKA

SEQ ID NO: 1365 - protein, 26 aa, Artificial Sequence
  Description of Artificial Sequence: Synthetic peptide
AEAAAKEAAAKAVAAEAAAKEAAAKA

SEQ ID NO: 1366 - protein, 25 aa, Artificial Sequence
  Description of Artificial Sequence: Synthetic peptide
SGGSGGGGSGGGGSGGGGSGGGSLQ

SEQ ID NO: 1367 - protein, 20 aa, Artificial Sequence
  Description of Artificial Sequence: Synthetic peptide
METDTLLLWVLLLWVPGSTG

SEQ ID NO: 1368 - protein, 20 aa, Artificial Sequence
  Description of Artificial Sequence: Synthetic peptide
  MISC_FEATURE (1)..(20): This sequence may encompass 1-20 residues
HHHHHHHHHHHHHHHHHHHH

SEQ ID NO: 1369 - protein, 107 aa, Homo sapiens
QVSPMHCLDEEGDDSDGASGDSGSGLGDARELLREETGAALKPRLPAPPPVTTPPLAGGSSTEDSRSEEVEEQTTVASLGAQTLPGSDSVSTWDGSVRTPGGRVKEG

SEQ ID NO: 1370 - protein, 26 aa, Homo sapiens
AAAPDVKELLSRLEELENLVSSLREQ

SEQ ID NO: 1371 - RNA, 38 nt, Artificial Sequence
  Description of Artificial Sequence: Synthetic oligonucleotide
gcaugcgaccucuguuugaucaaacagaggucgcaugc

SEQ ID NO: 1372 - RNA, 40 nt, Artificial Sequence
  Description of Artificial Sequence: Synthetic oligonucleotide
ggcaugcgaccucuguuugaucaaacagaggucgcaugcc

SEQ ID NO: 1373 - RNA, 28 nt, Artificial Sequence
  Description of Artificial Sequence: Synthetic oligonucleotide
ggcaugcgaccucuguuugaucagaggu

SEQ ID NO: 1374 - RNA, 29 nt, Artificial Sequence
  Description of Artificial Sequence: Synthetic oligonucleotide
ggcaugcgaccucuguuugaggucgcaug

SEQ ID NO: 1375 - RNA, 24 nt, Artificial Sequence
  Description of Artificial Sequence: Synthetic oligonucleotide
ggacguacguuucgacguacgucc

SEQ ID NO: 1376 - RNA, 32 nt, Artificial Sequence
  Description of Artificial Sequence: Synthetic oligonucleotide
ggaucgaucgaucguucgcgaucgaucgaucc

SEQ ID NO: 1377 - RNA, 45 nt, Artificial Sequence
  Description of Artificial Sequence: Synthetic oligonucleotide
aacacacacacacacacacacuuuguguguguguguguguguguu

SEQ ID NO: 1378 - RNA, 47 nt, Artificial Sequence
  Description of Artificial Sequence: Synthetic oligonucleotide
aacacacacacacacacacacuuuaaguguguguguguguguguguu

SEQ ID NO: 1379 - RNA, 52 nt, Artificial Sequence
  Description of Artificial Sequence: Synthetic oligonucleotide
ggacguacguuucgcgacuguagauuaaucuacagucgcgaaacguacgucc

SEQ ID NO: 1380 - RNA, 16 nt, Artificial Sequence
  Description of Artificial Sequence: Synthetic oligonucleotide
ggaucgaucgaucguu

SEQ ID NO: 1381 - RNA, 16 nt, Artificial Sequence
  Description of Artificial Sequence: Synthetic oligonucleotide
cgcgaucgaucgaucc

SEQ ID NO: 1382 - protein, 12 aa, Artificial Sequence
  Description of Artificial Sequence: Synthetic peptide
  MISC_FEATURE (1)..(12): This sequence may encompass 6-12 residues
RRRRRRRRRRRR

SEQ ID NO: 1383 - protein, 14 aa, Artificial Sequence
  Description of Artificial Sequence: Synthetic peptide
CAYGRKKRRQRRRG

SEQ ID NO: 1384 - protein, 12 aa, Artificial Sequence
  Description of Artificial Sequence: Synthetic peptide
GVFVLGFLGFLA

SEQ ID NO: 1385 - protein, 8 aa, Artificial Sequence
  Description of Artificial Sequence: Synthetic peptide
RRRRRRRR

SEQ ID NO: 1386 - protein, 24 aa, Artificial Sequence
  Description of Artificial Sequence: Synthetic peptide
DSHAKRHHGYKRKFHEKHHSHRGY

SEQ ID NO: 1387 - protein, 14 aa, Artificial Sequence
  Description of Artificial Sequence: Synthetic peptide
KRLFKKLLFSLRKY

SEQ ID NO: 1388 - protein, 26 aa, Artificial Sequence
  Description of Artificial Sequence: Synthetic peptide
CIGAVLKVLTTGLPALISWIKRKRQQ

SEQ ID NO: 1389 - protein, 27 aa, Artificial Sequence
  Description of Artificial Sequence: Synthetic peptide
CLIKKALAALAKLNIKLLYGASNLTWG

SEQ ID NO: 1390 - protein, 14 aa, Artificial Sequence
  Description of Artificial Sequence: Synthetic peptide
YKQSHKKGGKKGSG

SEQ ID NO: 1391 - protein, 18 aa, Artificial Sequence
  Description of Artificial Sequence: Synthetic peptide
VRLPPPVRLPPPVRLPPP

SEQ ID NO: 1392 - protein, 14 aa, Artificial Sequence
  Description of Artificial Sequence: Synthetic peptide
VSRRRRRRGGRRRR

SEQ ID NO: 1393 - protein, 16 aa, Artificial Sequence
  Description of Artificial Sequence: Synthetic peptide
EARPALLTSRLRFIPK

SEQ ID NO: 1394 - protein, 6 aa, Artificial Sequence
  Description of Artificial Sequence: Synthetic peptide
KALLAL

SEQ ID NO: 1395 - protein, 11 aa, Artificial Sequence
  Description of Artificial Sequence: Synthetic peptide
YGRKKRRQRRR

SEQ ID NO: 1396 - protein, 9 aa, Artificial Sequence
  Description of Artificial Sequence: Synthetic peptide
RRRRRRRRR

SEQ ID NO: 1397 - protein, 21 aa, Artificial Sequence
  Description of Artificial Sequence: Synthetic peptide
AGYLLGKINLKALAALAKKIL

SEQ ID NO: 1398 - protein, 28 aa, Artificial Sequence
  Description of Artificial Sequence: Synthetic peptide
LSTAADMQGVVTDGMASGLDKDYLKPDD

SEQ ID NO: 1399 - protein, 17 aa, Artificial Sequence
  Description of Artificial Sequence: Synthetic peptide
CSIPPEVKFNKPFVYLI

SEQ ID NO: 1400 - protein, 15 aa, Artificial Sequence
  Description of Artificial Sequence: Synthetic peptide
SDLWEMMMVSLACQY

SEQ ID NO: 1401 - protein, 14 aa, Artificial Sequence
  Description of Artificial Sequence: Synthetic peptide
LLLFLLKKRKKRKY

SEQ ID NO: 1402 - protein, 14 aa, Artificial Sequence
  Description of Artificial Sequence: Synthetic peptide
SYFILRRRRKRFPY

SEQ ID NO: 1403 - protein, 14 aa, Artificial Sequence
  Description of Artificial Sequence: Synthetic peptide
SYYMLRKRRKRLPY

SEQ ID NO: 1404 - protein, 14 aa, Artificial Sequence
  Description of Artificial Sequence: Synthetic peptide
LYYFIRKKRKRVPY

SEQ ID NO: 1405 - protein, 26 aa, Artificial Sequence
  Description of Artificial Sequence: Synthetic peptide
FAGVVIGLAALGVATAAQVTAAVALV

SEQ ID NO: 1406 - protein, 26 aa, Artificial Sequence
  Description of Artificial Sequence: Synthetic peptide
FIGAIIGSVALGVATAAQITAASALI

SEQ ID NO: 1407 - protein, 26 aa, Artificial Sequence
  Description of Artificial Sequence: Synthetic peptide
FFGGVIGTIALGVATSAQIYAAVALV

SEQ ID NO: 1408 - protein, 26 aa, Artificial Sequence
  Description of Artificial Sequence: Synthetic peptide
FAGVVLAGAALGVATAAQITAGIALH

SEQ ID NO: 1409 - protein, 26 aa, Artificial Sequence
  Description of Artificial Sequence: Synthetic peptide
LAGVIMAGVAIGIATAAQITAGVALY

SEQ ID NO: 1410 - protein, 22 aa, Artificial Sequence
  Description of Artificial Sequence: Synthetic peptide
SFIEDLLFNKVTLADAGFMKQY

SEQ ID NO: 1411 - protein, 21 aa, Artificial Sequence
  Description of Artificial Sequence: Synthetic peptide
KQYGECLGDINARDLICAQKF

SEQ ID NO: 1412 - protein, 23 aa, Artificial Sequence
  Description of Artificial Sequence: Synthetic peptide
GLFGAIAGFIENGWEGMIDGWYG

SEQ ID NO: 1413 - protein, 24 aa, Artificial Sequence
  Description of Artificial Sequence: Synthetic peptide
GLFEAIEGFIENGWEGMIDGWYGC

SEQ ID NO: 1414 - protein, 24 aa, Artificial Sequence
  Description of Artificial Sequence: Synthetic peptide
GLFEAIEGFIENGWEGMIDGWYGC

SEQ ID NO: 1415 - protein, 4 aa, Artificial Sequence
  Description of Artificial Sequence: Synthetic peptide
GFFG

SEQ ID NO: 1416 - protein, 3 aa, Artificial Sequence
  Description of Artificial Sequence: Synthetic peptide
GWG

SEQ ID NO: 1417 - protein, 4 aa, Artificial Sequence
  Description of Artificial Sequence: Synthetic peptide
GFWG

SEQ ID NO: 1418 - protein, 5 aa, Artificial Sequence
  Description of Artificial Sequence: Synthetic peptide
GFWFG

SEQ ID NO: 1419 - protein, 4 aa, Artificial Sequence
  Description of Artificial Sequence: Synthetic peptide
GWWG

SEQ ID NO: 1420 - protein, 6 aa, Artificial Sequence
  Description of Artificial Sequence: Synthetic peptide
GWGGWG

SEQ ID NO: 1421 - protein, 5 aa, Artificial Sequence
  Description of Artificial Sequence: Synthetic peptide
GWWWG

SEQ ID NO: 1422 - protein, 7 aa, Artificial Sequence
  Description of Artificial Sequence: Synthetic peptide
FFLIPKG

SEQ ID NO: 1423 - protein, 7 aa, Artificial Sequence
  Description of Artificial Sequence: Synthetic peptide
GKPILFF

SEQ ID NO: 1424 - RNA, 19 nt, Artificial Sequence
  Description of Artificial Sequence: Synthetic oligonucleotide
gcaugcgaccucuguuuga

SEQ ID NO: 1425 - RNA, 19 nt, Artificial Sequence
  Description of Artificial Sequence: Synthetic oligonucleotide
ucaaacagaggucgcaugc

SEQ ID NO: 1426 - RNA, 24 nt, Artificial Sequence
  Description of Artificial Sequence: Synthetic oligonucleotide
ggacguacguuucgcgacuguaga

SEQ ID NO: 1427 - RNA, 24 nt, Artificial Sequence
  Description of Artificial Sequence: Synthetic oligonucleotide
ucuacagucgcgaaacguacgucc

SEQ ID NO: 1428 - protein, 269 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSGGGGSVAGGGGSGGGGSMCMPCFTTDHQMARRCDDCCGGRGRGRCYGPQCLCR

SEQ ID NO: 1429 - protein, 275 aa, Artificial Sequence
  Description of Artificial Sequence: Synthetic polypeptide
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPPGGGGSGGGGSVAGGGGSGGGGSMCMPCFTTDHQMARRCDDCCGGRGRGRCYGPQCLCR

SEQ ID NO: 1430 - protein, 253 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGSVAGSMCMPCFTTDHQMARRCDDCCGGRGRGRCYGPQCLCR

SEQ ID NO: 1431 - protein, 265 aa, Artificial Sequence
  Description of Artificial Sequence: Synthetic polypeptide
MCMPCFTTDHQMARRCDDCCGGRGRGRCYGPQCLCRGGGGSVAGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPP

SEQ ID NO: 1432 - protein, 309 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRDPALVHQRPAPPEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1433 - protein, 407 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1434 - protein, 348 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIREPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSMCMPCFTTDHQMARRCDDCCGGRGRGKCYGPQCLCR

SEQ ID NO: 1435 - protein, 355 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIREPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSVAGGGGSGGGGSMCMPCFTTDHQMARRCDDCCGGRGRGKCYGPQCLCR

SEQ ID NO: 1436 - protein, 458 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSMCMPCFTTDHQMARRCDDCCGGRGRGKCYGPQCLCR

SEQ ID NO: 1437 - protein, 465 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSVAGGGGSGGGGSMCMPCFTTDHQMARRCDDCCGGRGRGKCYGPQCLCR

SEQ ID NO: 1438 - protein, 348 aa, Artificial Sequence
  Description of Artificial Sequence: Synthetic polypeptide
MCMPCFTTDHQMARRCDDCCGGRGRGKCYGPQCLCRGGGGSGGGGSGGGGSITCPPPMSVEHADIWVKSYSLYSRERYICNSGFKRKAGTSSLTECVLNKATNVAHWTTPSLKCIREPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1439 - protein, 355 aa, Artificial Sequence
  Description of Artificial Sequence: Synthetic polypeptide
MCMPCFTTDHQMARRCDDCCGGRGRGKCYGPQCLCRGGGGSGGGGSVAGGGGSGGGGSITCPPPMSVEHADIWVKSYSLYSRERYICNSGFKRKAGTSSLTECVLNKATNVAHWTTPSLKCIREPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1440 - protein, 458 aa, Artificial Sequence
  Description of Artificial Sequence: Synthetic polypeptide
MCMPCFTTDHQMARRCDDCCGGRGRGKCYGPQCLCRGGGGSGGGGSGGGGSITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1441 - protein, 465 aa, Artificial Sequence
  Description of Artificial Sequence: Synthetic polypeptide
MCMPCFTTDHQMARRCDDCCGGRGRGKCYGPQCLCRGGGGSGGGGSVAGGGGSGGGGSITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1442 - protein, 18 aa, Artificial Sequence
  Description of Artificial Sequence: Synthetic peptide
CSSLDEPGRGGFSSESKV

SEQ ID NO: 1443 - protein, 22 aa, Artificial Sequence
  Description of Artificial Sequence: Synthetic peptide
KCFQWQRNMRKVRGPPVSCIKR

SEQ ID NO: 1444 - protein, 7 aa, Artificial Sequence
  Description of Artificial Sequence: Synthetic peptide
LCLRPVG

SEQ ID NO: 1445 - protein, 21 aa, Artificial Sequence
  Description of Artificial Sequence: Synthetic peptide
VTPHHVLVDEYTGEWVDSQFK

SEQ ID NO: 1446 - protein, 14 aa, Artificial Sequence
  Description of Artificial Sequence: Synthetic peptide
YKQSHKKGGKKGSG

SEQ ID NO: 1447 - protein, 10 aa, Artificial Sequence
  Description of Artificial Sequence: Synthetic peptide
CRWRWKCCKK

SEQ ID NO: 1448 - protein, 17 aa, Artificial Sequence
  Description of Artificial Sequence: Synthetic peptide
GRPRESGKKRKRKRLKP

SEQ ID NO: 1449 - protein, 18 aa, Artificial Sequence
  Description of Artificial Sequence: Synthetic peptide
RKKRRRESRRARRSPRHL

SEQ ID NO: 1450 - protein, 14 aa, Artificial Sequence
  Description of Artificial Sequence: Synthetic peptide
SRRARRSPRHLGSG

SEQ ID NO: 1451 - protein, 22 aa, Artificial Sequence
  Description of Artificial Sequence: Synthetic peptide
TKRRITPKDVIDVRSVTTEINT

SEQ ID NO: 1452 - protein, 10 aa, Artificial Sequence
  Description of Artificial Sequence: Synthetic peptide
PRPLPFPRPG

SEQ ID NO: 1453 - protein, 16 aa, Artificial Sequence
  Description of Artificial Sequence: Synthetic peptide
GRQLRIAGRRLRGRSR

SEQ ID NO: 1454 - protein, 27 aa, Artificial Sequence
  Description of Artificial Sequence: Synthetic peptide
KLIKGRTPIKFGKADCDRPPKHSQNGK

SEQ ID NO: 1455 - protein, 12 aa, Artificial Sequence
  Description of Artificial Sequence: Synthetic peptide
KRIPNKKPGKKT

SEQ ID NO: 1456 - protein, 10 aa, Artificial Sequence
  Description of Artificial Sequence: Synthetic peptide
RRIPNRRPRR

SEQ ID NO: 1457 - protein, 11 aa, Artificial Sequence
  Description of Artificial Sequence: Synthetic peptide
KTIPSNKPKKK

SEQ ID NO: 1458 - protein, 17 aa, Artificial Sequence
  Description of Artificial Sequence: Synthetic peptide
DRRRRGSRPSGAERRRR

SEQ ID NO: 1459 - protein, 11 aa, Artificial Sequence
  Description of Artificial Sequence: Synthetic peptide
NRARRNRRRVR

SEQ ID NO: 1460 - protein, 16 aa, Artificial Sequence
  Description of Artificial Sequence: Synthetic peptide
KRPAAIKKAGQAKKKK

SEQ ID NO: 1461 - protein, 9 aa, Artificial Sequence
  Description of Artificial Sequence: Synthetic peptide
KCPSRRPKR

SEQ ID NO: 1462 - protein, 12 aa, Artificial Sequence
  Description of Artificial Sequence: Synthetic peptide
TRRSKRRSHRKF

SEQ ID NO: 1463 - protein, 25 aa, Artificial Sequence
  Description of Artificial Sequence: Synthetic peptide
GTKMIFVGIKKKEERADLIAYLKKA

SEQ ID NO: 1464 - protein, 19 aa, Artificial Sequence
  Description of Artificial Sequence: Synthetic peptide
NAKTRRHERRRKLAIERGC

SEQ ID NO: 1465 - protein, 24 aa, Artificial Sequence
  Description of Artificial Sequence: Synthetic peptide
MDAQTRRRERRAEKQAQWKAANGC

SEQ ID NO: 1466 - protein, 20 aa, Artificial Sequence
  Description of Artificial Sequence: Synthetic peptide
TAKTRYKARRAELIAERRGC

SEQ ID NO: 1467 - protein, 30 aa, Artificial Sequence
  Description of Artificial Sequence: Synthetic polypeptide
RIKAERKRMRNRIAASKSRKRKLERIARGC

SEQ ID NO: 1468 - protein, 24 aa, Artificial Sequence
  Description of Artificial Sequence: Synthetic peptide
KRARNTEAARRSRARKLQRMKQGC

SEQ ID NO: 1469 - protein, 20 aa, Artificial Sequence
  Description of Artificial Sequence: Synthetic peptide
GLWRALWRLLRSLWRLLWRA

SEQ ID NO: 1470 - protein, 34 aa, Artificial Sequence
  Description of Artificial Sequence: Synthetic polypeptide
DAATATRGRSAASRPTQRPRAPARSASRPRRPVE

SEQ ID NO: 1471 - protein, 34 aa, Artificial Sequence
  Description of Artificial Sequence: Synthetic polypeptide
AKVKDEPQRRSARLSAKPAPPKPEPKPKKAPAKK

SEQ ID NO: 1472 - protein, 12 aa, Artificial Sequence
  Description of Artificial Sequence: Synthetic peptide
PLSSIFSRIGDP

SEQ ID NO: 1473 - protein, 8 aa, Artificial Sequence
  Description of Artificial Sequence: Synthetic peptide
SKKKKTKV

SEQ ID NO: 1474 - protein, 8 aa, Artificial Sequence
  Description of Artificial Sequence: Synthetic peptide
GRKRKKRT

SEQ ID NO: 1475 - protein, 10 aa, Artificial Sequence
  Description of Artificial Sequence: Synthetic peptide
VQRKRQKLMP

SEQ ID NO: 1476 - protein, 14 aa, Artificial Sequence
  Description of Artificial Sequence: Synthetic peptide
YKQCHKKGGKKGSG

SEQ ID NO: 1477 - protein, 23 aa, Artificial Sequence
  Description of Artificial Sequence: Synthetic peptide
LIRLWSHLIHIWFQNRRLKWKKK

SEQ ID NO: 1478 - protein, 19 aa, Artificial Sequence
  Description of Artificial Sequence: Synthetic peptide
TRQARRNRRRRWRERQRGC

SEQ ID NO: 1479 - protein, 17 aa, Artificial Sequence
  Description of Artificial Sequence: Synthetic peptide
RRRRNRTRRNRRRVRGC

SEQ ID NO: 1480 - protein, 21 aa, Artificial Sequence
  Description of Artificial Sequence: Synthetic peptide
KMTRAQRRAAARRNRWTARGC

SEQ ID NO: 1481 - protein, 15 aa, Artificial Sequence
  Description of Artificial Sequence: Synthetic peptide
TRRQRTRRARRNRGC

SEQ ID NO: 1482 - protein, 10 aa, Artificial Sequence
  Description of Artificial Sequence: Synthetic peptide
KFFKFFKFFK

SEQ ID NO: 1483 - protein, 17 aa, Artificial Sequence
  Description of Artificial Sequence: Synthetic peptide
  MOD_RES (2)..(2): Any amino acid
  MOD_RES (5)..(5): Any amino acid
  MOD_RES (13)..(13): Any amino acid
  MOD_RES (16)..(16): Any amino acid
RXRRXRILFQYRXRRXR

SEQ ID NO: 1484 - protein, 17 aa, Artificial Sequence
  Description of Artificial Sequence: Synthetic peptide
  MOD_RES (2)..(2): Any amino acid
  MOD_RES (5)..(5): Any amino acid
  MOD_RES (13)..(13): Any amino acid
  MOD_RES (16)..(16): Any amino acid
RXRRXRYQFLIRXRRXR

SEQ ID NO: 1485 - protein, 17 aa, Artificial Sequence
  Description of Artificial Sequence: Synthetic peptide
  MOD_RES (2)..(2): Any amino acid
  MOD_RES (5)..(5): Any amino acid
  MOD_RES (13)..(13): Any amino acid
  MOD_RES (16)..(16): Any amino acid
RXRRXRIKFQYRXRRXR

SEQ ID NO: 1486 - protein, 17 aa, Artificial Sequence
  Description of Artificial Sequence: Synthetic peptide
  MOD_RES (2)..(2): Any amino acid
  MOD_RES (5)..(5): Any amino acid
  MOD_RES (13)..(13): Any amino acid
  MOD_RES (16)..(16): Any amino acid
RXRRXRIWFQYRXRRXR

SEQ ID NO: 1487 - protein, 12 aa, Artificial Sequence
  Description of Artificial Sequence: Synthetic peptide
GRKKRRQRRRPQ

SEQ ID NO: 1488 - protein, 11 aa, Artificial Sequence
  Description of Artificial Sequence: Synthetic peptide
GRKKRRQRRRP

SEQ ID NO: 1489 - protein, 11 aa, Artificial Sequence
  Description of Artificial Sequence: Synthetic peptide
GRKKRRQRRRG

SEQ ID NO: 1490 - protein, 9 aa, Artificial Sequence
  Description of Artificial Sequence: Synthetic peptide
RKKRRQRRR

SEQ ID NO: 1491 - protein, 112 aa, Homo sapiens
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFIN

SEQ ID NO: 1492 - protein, 15 aa, Artificial Sequence
  Description of Artificial Sequence: Synthetic peptide
CGYGRKKRRQRRRGC

SEQ ID NO: 1493 - protein, 321 aa, Artificial Sequence
  Description of Artificial Sequence: Synthetic polypeptide
  MOD_RES (21)..(89): This region may encompass one of the following sequences: "GSMCMPCFTTDHQMARKCDDCCGGKGRGKCYGPQCLCR" or "GSMCMPCFTTD HQMARRCDDCCGGRGRGKCYGPQCLCR" or "GSMCMPCFTTDHQMARRCDDCCG GRGRGRCYGPQCLCR" or "GSMCMPCFTTDHQMARKCDDCCGGRGRGRCYGPQC
  MOD_RES (21)..(89): CONT. FROM ABOVE: LCR" or "GSMCMPCFTTDHQMARRCDDCCGGKGRGRC YGPQCLCR" or "GSMCMPCFTTHHRMAENCDICCGGDGRGKCYGPQCLCR" or "GSMCMPCFTTDTQMQERCDRCCGGGGRGKCWGPQCLCI" or "GSMCMPCFTTDT QMQERCDRCCGGGGRGRCWGPQCLCI" or "GSMCMPCFTTEQRMAIICDDCCGGF
  MOD_RES (21)..(89): CONT. FROM ABOVE: GRGKCYGPQCLCR" or "GSMCMPCFTTEQRMAIICD DCCGGFGRGRCYGPQCLCR" or "GSICIPCFTTDHQIARRCDDCCGGRGRGKCYG PQCICR" or "GSICIPCFTTDHQIARRCDDCCGGRGRGRCYGPQCICR" or "G SMCMPCFTTDHRMAENCDICCGGDGRGKCYGPQCLCR" or "GSMCMPCFTTDHR
  MOD_RES (21)..(89): CONT. FROM ABOVE: MAENCDICCGGDGRGRCYGPQCLCR" or "GSMCMPC FTTEQRMAIICDDCCGGFGRGKCYGPQCLCI" or "GSMCMPCFTTEQRMAIICDD CCGGFGRGRCYGPQCLCI" or "GSICIPCFTTDHQIARRCDDCCGGRGRGKCYGP QCICI" or "GSICIPCFTTDHQIARRCDDCCGGRGRGRCYGPQCICI" or "G
  MOD_RES (21)..(89): CONT. FROM ABOVE: SMCMPCFTTDHRMAENCDICCGGDGRGKCYGPQCLCI" or "GSMCMPCFTTDHRMAENCDICCGGDGRGRCYGPQCLCI" or "GSMCMPCF TTDTQMQEKCDRCCGGGGRGRCWGPQCLCI" or "GSMCMPCFTTEQRMAIKCDDC CGGFGRGRCYGPQCLCR" or "GSICIPCFTTDHQIARKCDDCCGGRGRGRCYGP
  MOD_RES (21)..(89): CONT. FROM ABOVE: QCICR" or "GSMCMPCFTTDHRMAEKCDICCGGDGR GRCYGPQCLCR" or "GSMCMPCFTTDTQMQERCDRCCGGKGRGRCWGPQCLCI" or "GSMCMPCFTTEQRMAIICDDCCGGKGRGRCYGPQCLCR" or "GSICIPCFT TDHQIARRCDDCCGGKGRGRCYGPQCICR" or "GSMCMPCFTTDHRMAENCDIC
  MOD_RES (21)..(89): CONT. FROM ABOVE: CGGKGRGRCYGPQCLCR" or "GSMCMPCFTTHHRMA ENCDICCGGDGRGRCYGPQCLCR" or "GSMCMPCFTTDTQMQERCDRCCGGGGRG RCWGPQCLC" or "GSMCMPCFTTEQRMAIICDDCCGGFGRGRCYGPQCLC" or "GSICIPCFTTDHQIARRCDDCCGGRGRGRCYGPQCIC" or "GSMCMPCFTTDH
  MOD_RES (21)..(89): CONT. FROM ABOVE: RMAENCDICCGGDGRGRCYGPQCLC" or "GSMCMPC FTTDHQMARRCDDCCGGRGRGRCYGPQCLCI" or "GSACAPCFTTDHQAARRCDD CCGGRGRGKCYGPQCLCR" or "GSACAPCFTTDHQAARKCDDCCGGKGRGKCYGP QCLCR" or "GSMCMPCFTTHHRMAENCDICCGGDGRGKCYGPQCLCI" or "G
  MOD_RES (21)..(89): CONT. FROM ABOVE: SMCMPCFTTHHRMAENCDICCGGDGRGKCYGPQCLC" or "GSMCMPCFTTDHQMARRCDDCCGGRGRGRCYGPQCLC" or "GSMCMPCFTT HHQMAENCDICCGGDGRGKCYGPQCLCR" or "GSMCMPCFTTHHRMARNCDICCG GDGRGKCYGPQCLCR" or "GSMCMPCFTTHHRMAERCDICCGGDGRGKCYGPQC
  MOD_RES (21)..(89): CONT. FROM ABOVE: LCR" or "GSMCMPCFTTHHRMAENCDDCCGGDGRGK CYGPQCLCR" or "GSRCMPCFTTDHQMARRCDDCCGGRGRGKCYGPQCLCR" or "GSICIPCFTTDHQIARRCDDCCGGRGRGKCYGPQCLCR" or "GSMCLPCFTTD HQLARRCDDCCGGRGRGKCYGPQCLCR" or "GSMCMPCFTTEHQMARRCEECCG
  MOD_RES (21)..(89): CONT. FROM ABOVE: GRGRGKCYGPQCLCR" or "GSMCIPCFTTDHQMARR CEECCGGRGRGKCYGPQCLCR" or "GSICIPCFTTDHQMARRCDDCCGGRGDGKC YGPQCLCR" or "GSRCMPCFTTDHFMARFCDFCCGGRGRGKCYGPQCLCR" or "GSRCMPCFTTDHYMARYCDYCCGGRGRGKCYGPQCLCR" or "GSRCMPCFTTD
  MOD_RES (21)..(89): CONT. FROM ABOVE: HRMARRCDRCCGGRGRGKCYGPQCLCR" or "GSRCM PCFTTDHEMARECDECCGGRGRGKCYGPQCLCR" or "GSRCMPCFTTDHHMARHC DHCCGGRGRGKCYGPQCLCR" or "GSLCLPCFTTHHRLADQCDICCGGDGRGKCY GPQCLCR" or "GSICIPCFTTEHQIARRCEECCGGRGRGKCYGPQCLCR" or
  MOD_RES (21)..(89): CONT. FROM ABOVE: "GSMCMPCFTTIYRMAHECDECCGGRGRGKCYGPQCLC R" or "GSMCMPCFTTGYRMAEYCDICCGGRGRGKCYGPQCLCR" or "GSMCMP CFTTHRRMANTCDACCGGRSRGKCYGPQCLCR" or "GSHCMPCFTTDHQMIRRCD DCCGGGSYGKCDGPQCLCF" or "GSDCMPCFTTDHRMADHCDICCGGDDRGKCY
  MOD_RES (21)..(89): CONT. FROM ABOVE: GPQCLCR" or "GSMCMPCFTTDHEMERRCDDCCGIG GGGKCHGPQCLCG" or "GSMCMPCFTTSEQMFRRCDDCCGGWGDGKCNGPHCLCR " or "GSCGPCFTTDHQMEQKCAECCGGIGKCYGPQCLCNR" or "GSRCGPCFT TDPQTQAKCSECCGRKGGVCKGPQCICGIQY" or "GSMCMPCFTTDPNMAKKCR
  MOD_RES (21)..(89): CONT. FROM ABOVE: DCCGGNGKCFGPQCLCNR" or "GSMCMPCFTTDHNM AKKCNDCCGGYGKCFGPQCLCR" or "GSRCPPCFTTNPNMEADCRKCCGGRGYCA SYQCICPGG" or "GSMCMPCFTTDPNMANKCRDCCGGGKKCFGPQCLCNR" or "GSMKFLYGVILIALFLTVMTATLSEARCGPCFTTDPQTQAKCSECCGRKGGVCKG
  MOD_RES (21)..(89): CONT. FROM ABOVE: PQCICGIQY" or "GSMCMPCFTTRPDMAQQCRACCK GRGKCFGPQCLCGYD" or "GSMKFLYGIVFIALFLTVMTATLSDAMCMPCFTTDH NMAKKCRDCCGGNGKCFGPQCLCNRG" or "GSMCMPCFTTDHNMAKKCRDCCGGN GKCFGPQCLCNR" or "GSMKFLYGIVFITLFLTVMIATHTEAMCMPCFTTRPNM
  MOD_RES (21)..(89): CONT. FROM ABOVE: AQQCRDCCRGRGKCFGPQCLCGYD" or "GSMKFLYG IVFIALFLTVMIATHTEAMCMPCFTTRPNMAQQCRDCCRGRGKCFGPQCLCGYD" o r "GSRCKPCFTTDPQMSKKCADCCGGKGKGKCYGPQCLC" or "GSMKFLYGIVF ITLFLTVMIATHTEAAMCMPCFTTNLNMEQECRDCCGGTGRCFGPQCLCGYD" or
  MOD_RES (21)..(89): CONT. FROM ABOVE:  "GSRCSPCFTTDQQMTKKCYDCCGGKGKGKCYGPQCI CAPY" or "GSCGPCFTTDPYTESKCATCCGGRGKCVGPQCLCNRI" or "GSTE AMCMPCFTTDHNMAKKCRDCCGGNGKCFGYQCLCNRG" or "GSMKFLYGIVFIAL FLTVMFATQTDGCGPCFTTDANMARKCRECCGGIGKCFGPQCLCNRI" or "GSM
  MOD_RES (21)..(89): CONT. FROM ABOVE: KFLYGIVFIALFLTVMFATQTDGCGPCFTTDANMARKC RECCGGNGKCFGPQCLCNRE" or "GSMKFLYGTILIAFFLTVMIATHSEARCPPC FTTNPNMEADCRKCCGGRGYCASYQCICPGG" or "GSTEAMCMPCFTTRPDMAQQ CRDCCGGNGKCFGYQCLCNRG" or "GSMKFLYGIVFIALFLTVMIATLTEAMCM
  MOD_RES (21)..(89): CONT. FROM ABOVE: PCFTTRPDMAQQCRDCCGGNGKCFGYQCLCNRG" or "GSMKFLYGIVFIALFLTVMIATHTEAMCMPCFTTRPDMAQQCRDCCGGNGKCFGYQ CLCNRG" or "GSMKFLYGIILIALFLTVMIATHSEARCPNCFTTNPNAEADCKKC CGNRWGKCAGYQCVCPMK" or "GSMKFLYGIVFIALFLTGMIATHTEAMCMPCF
  MOD_RES (21)..(89): CONT. FROM ABOVE: TTRPDMAQQCRDCCGGNGKCFGYQCLCNRGRIVIMYT" or "GSMCMPCFTTRPGMAQQCRDCCGGNGKCFGYQCLCNR" or "GSMCIPCFT TNPNMAAKCNACCGSRRGSCRGPQCICR" or "GSMCIPCFTTNPNMAAKCNACCG SRRGSCRGPQCICN" or "GSMCIPCFTTNPNMAAKCNACCGGNGSCRGPQCICN
  MOD_RES (21)..(89): CONT. FROM ABOVE: " or "GSMCIPCFTTNPNMAAKCNACCGSRGRGSCRG PQCICN" or "GSMCIPCFTTNPNMAAKCNACCGSRGRGKCRGPQCICN" or "G SMCIPCFTTDHQMAAKCNACCGSRRGSCRGPQCICN" or "GSMCIPCFTTNHQMA AKCNACCGSRRGSCRGPQCICN" or "GSMCIPCFTTNPNMARKCNACCGSRGRG
  MOD_RES (21)..(89): CONT. FROM ABOVE: SCRGPQCICN" or "GSMCIPCFTTNPNMAAKCNACC GGKGRGSCRGPQCICN" or "GSMCIPCFTTNPNMAAKCNACCGSRRGSCFGPQCI CN" or "GSMCIPCFTTNPNMAAKCNACCGSRGRGKCFGPQCICN" or "GSMCI PCFTTNPNMAAKCNACCGSRGRGSCFGPQCICN" or "GSMCIPCFTTNPNMAAK
  MOD_RES (21)..(89): CONT. FROM ABOVE: CNACCGSRGRGSCYGPQCICN" or "GSMCIPCFTTN PNMAAKCDACCGSRRGSCRGPQCICN" or "GSMCIPCFTTNHQMAAKCDACCGSR RGSCRGPQCICN" or "GSMCIPCFTTNHNMAAKCDACCGGRGRGSCRGPQCICN" or "GSMCIPCFTTNPNMAAKCDACCGSRGRGSCRGPQCICN" or "GSMCIPC
  MOD_RES (21)..(89): CONT. FROM ABOVE: FTTNPNMAAKCDACCGGKGRGSCRGPQCICN" or "G SMCIPCFTTNHNMAAKCDACCGSRGRGSCRGPQCICN" or "GSMCIPCFTTNPNM AAKCRDCCGGRGSCRGPQCICN" or "GSMCMPCFTTNPNMAAKCDDCCGSRGRGS CRGPQCICN" or "GSMCIPCFTTNPNMAARCNACCGSRRGSCRGPQCIC" or
  MOD_RES (21)..(89): CONT. FROM ABOVE: "GSMCIPCFTTNPNMAAKCNACCGSRRGSCRGPQCICI " or "GSMCMPCFTTDHQMARACDDCCGGKGRGKCYGPQCLCR" or "GSMCMPC FTTDHQMARRCDDCCGGKGRGKCYGPQCLCR" or "GSMCMPCFTTDHQMARKCDD CCGGAGRGKCYGPQCLCR" or "GSMCMPCFTTDHQMARACDDCCGGAGRGKCYG
  MOD_RES (21)..(89): CONT. FROM ABOVE: PQCLCR" or "GSMCMPCFTTDHQMARRCDDCCGGAG RGKCYGPQCLCR" or "GSMCMPCFTTDHQMARKCDDCCGGRGRGKCYGPQCLCR" or "GSMCMPCFTTDHQMARACDDCCGGRGRGKCYGPQCLCR" or "GSMCMPCF TTDHQMARKCDDCCGGKGRGACYGPQCLCR" or "GSMCMPCFTTDHQMARACDD
  MOD_RES (21)..(89): CONT. FROM ABOVE: CCGGKGRGACYGPQCLCR" or "GSMCMPCFTTDHQM ARRCDDCCGGKGRGACYGPQCLCR" or "GSMCMPCFTTDHQMARKCDDCCGGAGR GACYGPQCLCR" or "GSMCMPCFTTDHQMARACDDCCGGAGRGACYGPQCLCR" or "GSMCMPCFTTDHQMARRCDDCCGGAGRGACYGPQCLCR" or "GSMCMPCF
  MOD_RES (21)..(89): CONT. FROM ABOVE: TTDHQMARKCDDCCGGRGRGACYGPQCLCR" or "GS MCMPCFTTDHQMARACDDCCGGRGRGACYGPQCLCR" or "GSMCMPCFTTDHQMA RRCDDCCGGRGRGACYGPQCLCR" or "GSMCMPCFTTDHQMARKCDDCCGGKGRG RCYGPQCLCR" or "GSMCMPCFTTDHQMARACDDCCGGKGRGRCYGPQCLCR"
  MOD_RES (21)..(89): CONT. FROM ABOVE: or "GSMCMPCFTTDHQMARKCDDCCGGAGRGRCYGPQ CLCR" or "GSMCMPCFTTDHQMARACDDCCGGAGRGRCYGPQCLCR" or "GSM CMPCFTTDHQMARRCDDCCGGAGRGRCYGPQCLCR" or "GSMCMPCFTTDHQMAR ACDDCCGGRGRGRCYGPQCLCR" or "GSKCMPCFTTDHQMARRCDDCCGGRGRG
  MOD_RES (21)..(89): CONT. FROM ABOVE: RCYGPQCLCR" or "GSACAPCFTTDHQAARRCDDCC GGRGRGRCYGPQCLCR" or "GSKCAPCFTTDHQAARRCDDCCGGRGRGRCYGPQC LCR" or "GSMCMPCFTTDHQMARCDDCCGGGRGKCYGPQCLCR" or "GSMCMP CFTTDHQMARCDDCCGGGRGCYGPQCLCR" or "GSKCMPCFTTDHQMARCDDCC
  MOD_RES (21)..(89): CONT. FROM ABOVE: GGGRGCYGPQCLCR" or "GSACAPCFTTDHQAARCD DCCGGGRGKCYGPQCLCR" or "GSACAPCFTTDHQAARCDDCCGGGRGCYGPQCL CR" or "GSKCAPCFTTDHQAARCDDCCGGGRGCYGPQCLCR" or "GSMCMPCF TTDHQMARKCDDCCGGKGRGKCYGPQCLCRGAGAAGG" or "GSMCMPCFTTDHQ
  MOD_RES (21)..(89): CONT. FROM ABOVE: MARACDDCCGGKGRGKCYGPQCLCRGAGAAGG" or " GSMCMPCFTTDHQMARRCDDCCGGKGRGKCYGPQCLCRGAGAAGG" or "GSMCMP CFTTDHQMARKCDDCCGGAGRGKCYGPQCLCRGAGAAGG" or "GSMCMPCFTTDH QMARACDDCCGGAGRGKCYGPQCLCRGAGAAGG" or "GSMCMPCFTTDHQMARR
  MOD_RES (21)..(89): CONT. FROM ABOVE: CDDCCGGAGRGKCYGPQCLCRGAGAAGG" or "GSMC MPCFTTDHQMARKCDDCCGGRGRGKCYGPQCLCRGAGAAGG" or "GSMCMPCFTT DHQMARACDDCCGGRGRGKCYGPQCLCRGAGAAGG" or "GSMCMPCFTTDHQMAR RCDDCCGGRGRGKCYGPQCLCRGAGAAGG" or "GSMCMPCFTTDHQMARKCDDC
  MOD_RES (21)..(89): CONT. FROM ABOVE: CGGKGRGACYGPQCLCRGAGAAGG" or "GSMCMPCF TTDHQMARACDDCCGGKGRGACYGPQCLCRGAGAAGG" or "GSMCMPCFTTDHQM ARRCDDCCGGKGRGACYGPQCLCRGAGAAGG" or "GSMCMPCFTTDHQMARKCDD CCGGAGRGACYGPQCLCRGAGAAGG" or "GSMCMPCFTTDHQMARACDDCCGGA
  MOD_RES (21)..(89): CONT. FROM ABOVE: GRGACYGPQCLCRGAGAAGG" or "GSMCMPCFTTDH QMARRCDDCCGGAGRGACYGPQCLCRGAGAAGG" or "GSMCMPCFTTDHQMARKC DDCCGGRGRGACYGPQCLCRGAGAAGG" or "GSMCMPCFTTDHQMARACDDCCGG RGRGACYGPQCLCRGAGAAGG" or "GSMCMPCFTTDHQMARRCDDCCGGRGRGA
  MOD_RES (21)..(89): CONT. FROM ABOVE: CYGPQCLCRGAGAAGG" or "GSMCMPCFTTDHQMAR KCDDCCGGKGRGRCYGPQCLCRGAGAAGG" or "GSMCMPCFTTDHQMARACDDCC GGKGRGRCYGPQCLCRGAGAAGG" or "GSMCMPCFTTDHQMARRCDDCCGGKGRG RCYGPQCLCRGAGAAGG" or "GSMCMPCFTTDHQMARKCDDCCGGAGRGRCYGP
  MOD_RES (21)..(89): CONT. FROM ABOVE: QCLCRGAGAAGG" or "GSMCMPCFTTDHQMARACDD CCGGAGRGRCYGPQCLCRGAGAAGG" or "GSMCMPCFTTDHQMARRCDDCCGGAG RGRCYGPQCLCRGAGAAGG" or "GSMCMPCFTTDHQMARKCDDCCGGRGRGRCYG PQCLCRGAGAAGG" or "GSMCMPCFTTDHQMARACDDCCGGRGRGRCYGPQCLC
  MOD_RES (21)..(89): CONT. FROM ABOVE: RGAGAAGG" or "GSMCMPCFTTDHQMARRCDDCCGG RGRGRCYGPQCLCRGAGAAGG" or "GSKCMPCFTTDHQMARRCDDCCGGRGRGRC YGPQCLCRGAGAAGG" or "GSACAPCFTTDHQAARRCDDCCGGRGRGRCYGPQCL CRGAGAAGG" or "GSKCAPCFTTDHQAARRCDDCCGGRGRGRCYGPQCLCRGAG
  MOD_RES (21)..(89): CONT. FROM ABOVE: AAGG" or "GSMCMPCFTTDHQMARCDDCCGGGRGKC YGPQCLCRGAGAAGG" or "GSMCMPCFTTDHQMARCDDCCGGGRGCYGPQCLCRG AGAAGG" or "GSKCMPCFTTDHQMARCDDCCGGGRGCYGPQCLCRGAGAAGG" o r "GSACAPCFTTDHQAARCDDCCGGGRGKCYGPQCLCRGAGAAGG" or "GSAC
  MOD_RES (21)..(89): CONT. FROM ABOVE: APCFTTDHQAARCDDCCGGGRGCYGPQCLCRGAGAAGG " or "GSKCAPCFTTDHQAARCDDCCGGGRGCYGPQCLCRGAGAAGG" or "GSM CMPCFTTDHQMVRKCDDCCGGKGRGKCYGPQCLCR" or "GSMCMPCFTTDHQMVR VCDDCCGGKGRGKCYGPQCLCR" or "GSMCMPCFTTDHQMVRRCDDCCGGKGRG
  MOD_RES (21)..(89): CONT. FROM ABOVE: KCYGPQCLCR" or "GSMCMPCFTTDHQMVRKCDDCC GGVGRGKCYGPQCLCR" or "GSMCMPCFTTDHQMVRVCDDCCGGVGRGKCYGPQC LCR" or "GSMCMPCFTTDHQMVRRCDDCCGGVGRGKCYGPQCLCR" or "GSMC MPCFTTDHQMVRKCDDCCGGRGRGKCYGPQCLCR" or "GSMCMPCFTTDHQMVR
  MOD_RES (21)..(89): CONT. FROM ABOVE: VCDDCCGGRGRGKCYGPQCLCR" or "GSMCMPCFTT DHQMVRRCDDCCGGRGRGKCYGPQCLCR" or "GSMCMPCFTTDHQMVRKCDDCCG GKGRGVCYGPQCLCR" or "GSMCMPCFTTDHQMVRVCDDCCGGKGRGVCYGPQCL CR" or "GSMCMPCFTTDHQMVRRCDDCCGGKGRGVCYGPQCLCR" or "GSMC
  MOD_RES (21)..(89): CONT. FROM ABOVE: MPCFTTDHQMVRKCDDCCGGVGRGVCYGPQCLCR" or "GSMCMPCFTTDHQMVRVCDDCCGGVGRGVCYGPQCLCR" or "GSMCMPCFTTD HQMVRRCDDCCGGVGRGVCYGPQCLCR" or "GSMCMPCFTTDHQMVRKCDDCCGG RGRGVCYGPQCLCR" or "GSMCMPCFTTDHQMVRVCDDCCGGRGRGVCYGPQCL
  MOD_RES (21)..(89): CONT. FROM ABOVE: CR" or "GSMCMPCFTTDHQMVRRCDDCCGGRGRGVC YGPQCLCR" or "GSMCMPCFTTDHQMVRKCDDCCGGKGRGRCYGPQCLCR" or "GSMCMPCFTTDHQMVRVCDDCCGGKGRGRCYGPQCLCR" or "GSMCMPCFTTDH QMVRRCDDCCGGKGRGRCYGPQCLCR" or "GSMCMPCFTTDHQMVRKCDDCCGG
  MOD_RES (21)..(89): CONT. FROM ABOVE: VGRGRCYGPQCLCR" or "GSMCMPCFTTDHQMVRVC DDCCGGVGRGRCYGPQCLCR" or "GSMCMPCFTTDHQMVRRCDDCCGGVGRGRCY GPQCLCR" or "GSMCMPCFTTDHQMVRKCDDCCGGRGRGRCYGPQCLCR" or " GSMCMPCFTTDHQMVRVCDDCCGGRGRGRCYGPQCLCR" or "GSMCMPCFTTDH
  MOD_RES (21)..(89): CONT. FROM ABOVE: QMVRRCDDCCGGRGRGRCYGPQCLCR" or "GSKCMP CFTTDHQMVRRCDDCCGGRGRGRCYGPQCLCR" or "GSVCVPCFTTDHQVVRRCD DCCGGRGRGRCYGPQCLCR" or "GSKCVPCFTTDHQVVRRCDDCCGGRGRGRCYG PQCLCR" or "GSMCMPCFTTDHQMVRCDDCCGGGRGKCYGPQCLCR" or "GS
  MOD_RES (21)..(89): CONT. FROM ABOVE: MCMPCFTTDHQMVRCDDCCGGGRGCYGPQCLCR" or "GSKCMPCFTTDHQMVRCDDCCGGGRGCYGPQCLCR" or "GSVCVPCFTTDHQVV RCDDCCGGGRGKCYGPQCLCR" or "GSVCVPCFTTDHQVVRCDDCCGGGRGCYGP QCLCR" or "GSKCVPCFTTDHQVVRCDDCCGGGRGCYGPQCLCR" or "GSMC
  MOD_RES (21)..(89): CONT. FROM ABOVE: MPCFTTDHQMVRKCDDCCGGKGRGKCYGPQCLCRGAGA AGG" or "GSMCMPCFTTDHQMVRVCDDCCGGKGRGKCYGPQCLCRGAGAAGG" o r "GSMCMPCFTTDHQMVRRCDDCCGGKGRGKCYGPQCLCRGAGAAGG" or "GSM CMPCFTTDHQMVRKCDDCCGGVGRGKCYGPQCLCRGAGAAGG" or "GSMCMPCF
  MOD_RES (21)..(89): CONT. FROM ABOVE: TTDHQMVRVCDDCCGGVGRGKCYGPQCLCRGAGAAGG" or "GSMCMPCFTTDHQMVRRCDDCCGGVGRGKCYGPQCLCRGAGAAGG" or "G SMCMPCFTTDHQMVRKCDDCCGGRGRGKCYGPQCLCRGAGAAGG" or "GSMCMPC FTTDHQMVRVCDDCCGGRGRGKCYGPQCLCRGAGAAGG" or "GSMCMPCFTTDH
  MOD_RES (21)..(89): CONT. FROM ABOVE: QMVRRCDDCCGGRGRGKCYGPQCLCRGAGAAGG" or "GSMCMPCFTTDHQMVRKCDDCCGGKGRGVCYGPQCLCRGAGAAGG" or "GSMCM PCFTTDHQMVRVCDDCCGGKGRGVCYGPQCLCRGAGAAGG" or "GSMCMPCFTTD HQMVRRCDDCCGGKGRGVCYGPQCLCRGAGAAGG" or "GSMCMPCFTTDHQMVR
  MOD_RES (21)..(89): CONT. FROM ABOVE: KCDDCCGGVGRGVCYGPQCLCRGAGAAGG" or "GSM CMPCFTTDHQMVRVCDDCCGGVGRGVCYGPQCLCRGAGAAGG" or "GSMCMPCFT TDHQMVRRCDDCCGGVGRGVCYGPQCLCRGAGAAGG" or "GSMCMPCFTTDHQMV RKCDDCCGGRGRGVCYGPQCLCRGAGAAGG" or "GSMCMPCFTTDHQMVRVCDD
  MOD_RES (21)..(89): CONT. FROM ABOVE: CCGGRGRGVCYGPQCLCRGAGAAGG" or "GSMCMPC FTTDHQMVRRCDDCCGGRGRGVCYGPQCLCRGAGAAGG" or "GSMCMPCFTTDHQ MVRKCDDCCGGKGRGRCYGPQCLCRGAGAAGG" or "GSMCMPCFTTDHQMVRVCD DCCGGKGRGRCYGPQCLCRGAGAAGG" or "GSMCMPCFTTDHQMVRRCDDCCGG
  MOD_RES (21)..(89): CONT. FROM ABOVE: KGRGRCYGPQCLCRGAGAAGG" or "GSMCMPCFTTD HQMVRKCDDCCGGVGRGRCYGPQCLCRGAGAAGG" or "GSMCMPCFTTDHQMVRV CDDCCGGVGRGRCYGPQCLCRGAGAAGG" or "GSMCMPCFTTDHQMVRRCDDCCG GVGRGRCYGPQCLCRGAGAAGG" or "GSMCMPCFTTDHQMVRKCDDCCGGRGRG
  MOD_RES (21)..(89): CONT. FROM ABOVE: RCYGPQCLCRGAGAAGG" or "GSMCMPCFTTDHQMV RVCDDCCGGRGRGRCYGPQCLCRGAGAAGG" or "GSMCMPCFTTDHQMVRRCDDC CGGRGRGRCYGPQCLCRGAGAAGG" or "GSKCMPCFTTDHQMVRRCDDCCGGRGR GRCYGPQCLCRGAGAAGG" or "GSVCVPCFTTDHQVVRRCDDCCGGRGRGRCYG
  MOD_RES (21)..(89): CONT. FROM ABOVE: PQCLCRGAGAAGG" or "GSKCVPCFTTDHQVVRRCD DCCGGRGRGRCYGPQCLCRGAGAAGG" or "GSMCMPCFTTDHQMVRCDDCCGGGR GKCYGPQCLCRGAGAAGG" or "GSMCMPCFTTDHQMVRCDDCCGGGRGCYGPQCL CRGAGAAGG" or "GSKCMPCFTTDHQMVRCDDCCGGGRGCYGPQCLCRGAGAAG
  MOD_RES (21)..(89): CONT. FROM ABOVE: G" or "GSVCVPCFTTDHQVVRCDDCCGGGRGKCYGP QCLCRGAGAAGG" or "GSVCVPCFTTDHQVVRCDDCCGGGRGCYGPQCLCRGAGA AGG" or "GSKCVPCFTTDHQVVRCDDCCGGGRGCYGPQCLCRGAGAAGG" or " GSMCMPCFTTDHQMLRKCDDCCGGKGRGKCYGPQCLCR" or "GSMCMPCFTTDH
  MOD_RES (21)..(89): CONT. FROM ABOVE: QMLRLCDDCCGGKGRGKCYGPQCLCR" or "GSMCMP CFTTDHQMLRRCDDCCGGKGRGKCYGPQCLCR" or "GSMCMPCFTTDHQMLRKCD DCCGGLGRGKCYGPQCLCR" or "GSMCMPCFTTDHQMLRLCDDCCGGLGRGKCYG PQCLCR" or "GSMCMPCFTTDHQMLRRCDDCCGGLGRGKCYGPQCLCR" or "
  MOD_RES (21)..(89): CONT. FROM ABOVE: GSMCMPCFTTDHQMLRKCDDCCGGRGRGKCYGPQCLCR " or "GSMCMPCFTTDHQMLRLCDDCCGGRGRGKCYGPQCLCR" or "GSMCMPC FTTDHQMLRRCDDCCGGRGRGKCYGPQCLCR" or "GSMCMPCFTTDHQMLRKCDD CCGGKGRGLCYGPQCLCR" or "GSMCMPCFTTDHQMLRLCDDCCGGKGRGLCYG
  MOD_RES (21)..(89): CONT. FROM ABOVE: PQCLCR" or "GSMCMPCFTTDHQMLRRCDDCCGGKG RGLCYGPQCLCR" or "GSMCMPCFTTDHQMLRKCDDCCGGLGRGLCYGPQCLCR" or "GSMCMPCFTTDHQMLRLCDDCCGGLGRGLCYGPQCLCR" or "GSMCMPCF TTDHQMLRRCDDCCGGLGRGLCYGPQCLCR" or "GSMCMPCFTTDHQMLRKCDD
  MOD_RES (21)..(89): CONT. FROM ABOVE: CCGGRGRGLCYGPQCLCR" or "GSMCMPCFTTDHQM LRLCDDCCGGRGRGLCYGPQCLCR" or "GSMCMPCFTTDHQMLRRCDDCCGGRGR GLCYGPQCLCR" or "GSMCMPCFTTDHQMLRKCDDCCGGKGRGRCYGPQCLCR" or "GSMCMPCFTTDHQMLRLCDDCCGGKGRGRCYGPQCLCR" or "GSMCMPCF
  MOD_RES (21)..(89): CONT. FROM ABOVE: TTDHQMLRRCDDCCGGKGRGRCYGPQCLCR" or "GS MCMPCFTTDHQMLRKCDDCCGGLGRGRCYGPQCLCR" or "GSMCMPCFTTDHQML RLCDDCCGGLGRGRCYGPQCLCR" or "GSMCMPCFTTDHQMLRRCDDCCGGLGRG RCYGPQCLCR" or "GSMCMPCFTTDHQMLRKCDDCCGGRGRGRCYGPQCLCR"
  MOD_RES (21)..(89): CONT. FROM ABOVE: or "GSMCMPCFTTDHQMLRLCDDCCGGRGRGRCYGPQ CLCR" or "GSMCMPCFTTDHQMLRRCDDCCGGRGRGRCYGPQCLCR" or "GSK CMPCFTTDHQMLRRCDDCCGGRGRGRCYGPQCLCR" or "GSLCLPCFTTDHQLLR RCDDCCGGRGRGRCYGPQCLCR" or "GSKCLPCFTTDHQLLRRCDDCCGGRGRG
  MOD_RES (21)..(89): CONT. FROM ABOVE: RCYGPQCLCR" or "GSMCMPCFTTDHQMLRCDDCCG GGRGKCYGPQCLCR" or "GSMCMPCFTTDHQMLRCDDCCGGGRGCYGPQCLCR" or "GSKCMPCFTTDHQMLRCDDCCGGGRGCYGPQCLCR" or "GSLCLPCFTTDH QLLRCDDCCGGGRGKCYGPQCLCR" or "GSLCLPCFTTDHQLLRCDDCCGGGRG
  MOD_RES (21)..(89): CONT. FROM ABOVE: CYGPQCLCR" or "GSKCLPCFTTDHQLLRCDDCCGG GRGCYGPQCLCR" or "GSMCMPCFTTDHQMLRKCDDCCGGKGRGKCYGPQCLCRG AGAAGG" or "GSMCMPCFTTDHQMLRLCDDCCGGKGRGKCYGPQCLCRGAGAAGG " or "GSMCMPCFTTDHQMLRRCDDCCGGKGRGKCYGPQCLCRGAGAAGG" or
  MOD_RES (21)..(89): CONT. FROM ABOVE: "GSMCMPCFTTDHQMLRKCDDCCGGLGRGKCYGPQCLC RGAGAAGG" or "GSMCMPCFTTDHQMLRLCDDCCGGLGRGKCYGPQCLCRGAGAA GG" or "GSMCMPCFTTDHQMLRRCDDCCGGLGRGKCYGPQCLCRGAGAAGG" or "GSMCMPCFTTDHQMLRKCDDCCGGRGRGKCYGPQCLCRGAGAAGG" or "GSM
  MOD_RES (21)..(89): CONT. FROM ABOVE: CMPCFTTDHQMLRLCDDCCGGRGRGKCYGPQCLCRGAG AAGG" or "GSMCMPCFTTDHQMLRRCDDCCGGRGRGKCYGPQCLCRGAGAAGG" or "GSMCMPCFTTDHQMLRKCDDCCGGKGRGLCYGPQCLCRGAGAAGG" or "GS MCMPCFTTDHQMLRLCDDCCGGKGRGLCYGPQCLCRGAGAAGG" or "GSMCMPC
  MOD_RES (21)..(89): CONT. FROM ABOVE: FTTDHQMLRRCDDCCGGKGRGLCYGPQCLCRGAGAAGG " or "GSMCMPCFTTDHQMLRKCDDCCGGLGRGLCYGPQCLCRGAGAAGG" or " GSMCMPCFTTDHQMLRLCDDCCGGLGRGLCYGPQCLCRGAGAAGG" or "GSMCMP CFTTDHQMLRRCDDCCGGLGRGLCYGPQCLCRGAGAAGG" or "GSMCMPCFTTD
  MOD_RES (21)..(89): CONT. FROM ABOVE: HQMLRKCDDCCGGRGRGLCYGPQCLCRGAGAAGG" or "GSMCMPCFTTDHQMLRLCDDCCGGRGRGLCYGPQCLCRGAGAAGG" or "GSMC MPCFTTDHQMLRRCDDCCGGRGRGLCYGPQCLCRGAGAAGG" or "GSMCMPCFTT DHQMLRKCDDCCGGKGRGRCYGPQCLCRGAGAAGG" or "GSMCMPCFTTDHQML
  MOD_RES (21)..(89): CONT. FROM ABOVE: RLCDDCCGGKGRGRCYGPQCLCRGAGAAGG" or "GS MCMPCFTTDHQMLRRCDDCCGGKGRGRCYGPQCLCRGAGAAGG" or "GSMCMPCF TTDHQMLRKCDDCCGGLGRGRCYGPQCLCRGAGAAGG" or "GSMCMPCFTTDHQM LRLCDDCCGGLGRGRCYGPQCLCRGAGAAGG" or "GSMCMPCFTTDHQMLRRCD
  MOD_RES (21)..(89): CONT. FROM ABOVE: DCCGGLGRGRCYGPQCLCRGAGAAGG" or "GSMCMP CFTTDHQMLRKCDDCCGGRGRGRCYGPQCLCRGAGAAGG" or "GSMCMPCFTTDH QMLRLCDDCCGGRGRGRCYGPQCLCRGAGAAGG" or "GSMCMPCFTTDHQMLRRC DDCCGGRGRGRCYGPQCLCRGAGAAGG" or "GSKCMPCFTTDHQMLRRCDDCCG
  MOD_RES (21)..(89): CONT. FROM ABOVE: GRGRGRCYGPQCLCRGAGAAGG" or "GSLCLPCFTT DHQLLRRCDDCCGGRGRGRCYGPQCLCRGAGAAGG" or "GSKCLPCFTTDHQLLR RCDDCCGGRGRGRCYGPQCLCRGAGAAGG" or "GSMCMPCFTTDHQMLRCDDCCG GGRGKCYGPQCLCRGAGAAGG" or "GSMCMPCFTTDHQMLRCDDCCGGGRGCYG
  MOD_RES (21)..(89): CONT. FROM ABOVE: PQCLCRGAGAAGG" or "GSKCMPCFTTDHQMLRCDD CCGGGRGCYGPQCLCRGAGAAGG" or "GSLCLPCFTTDHQLLRCDDCCGGGRGKC YGPQCLCRGAGAAGG" or "GSLCLPCFTTDHQLLRCDDCCGGGRGCYGPQCLCRG AGAAGG" or "GSKCLPCFTTDHQLLRCDDCCGGGRGCYGPQCLCRGAGAAGG"
  MOD_RES (21)..(89): CONT. FROM ABOVE: or "GSGCGPCFTTDHQGARKCDDCCGGKGRGKCYGPQ CLCR" or "GSGCGPCFTTDHQGARACDDCCGGKGRGKCYGPQCLCR" or "GSG CGPCFTTDHQGARRCDDCCGGKGRGKCYGPQCLCR" or "GSGCGPCFTTDHQGAR KCDDCCGGAGRGKCYGPQCLCR" or "GSGCGPCFTTDHQGARACDDCCGGAGRG
  MOD_RES (21)..(89): CONT. FROM ABOVE: KCYGPQCLCR" or "GSGCGPCFTTDHQGARRCDDCC GGAGRGKCYGPQCLCR" or "GSGCGPCFTTDHQGARKCDDCCGGRGRGKCYGPQC LCR" or "GSGCGPCFTTDHQGARACDDCCGGRGRGKCYGPQCLCR" or "GSGC GPCFTTDHQGARRCDDCCGGRGRGKCYGPQCLCR" or "GSGCGPCFTTDHQGAR
  MOD_RES (21)..(89): CONT. FROM ABOVE: KCDDCCGGKGRGACYGPQCLCR" or "GSGCGPCFTT DHQGARACDDCCGGKGRGACYGPQCLCR" or "GSGCGPCFTTDHQGARRCDDCCG GKGRGACYGPQCLCR" or "GSGCGPCFTTDHQGARKCDDCCGGAGRGACYGPQCL CR" or "GSGCGPCFTTDHQGARACDDCCGGAGRGACYGPQCLCR" or "GSGC
  MOD_RES (21)..(89): CONT. FROM ABOVE: GPCFTTDHQGARRCDDCCGGAGRGACYGPQCLCR" or "GSGCGPCFTTDHQGARKCDDCCGGRGRGACYGPQCLCR" or "GSGCGPCFTTD HQGARACDDCCGGRGRGACYGPQCLCR" or "GSGCGPCFTTDHQGARRCDDCCGG RGRGACYGPQCLCR" or "GSGCGPCFTTDHQGARKCDDCCGGKGRGRCYGPQCL
  MOD_RES (21)..(89): CONT. FROM ABOVE: CR" or "GSGCGPCFTTDHQGARACDDCCGGKGRGRC YGPQCLCR" or "GSGCGPCFTTDHQGARRCDDCCGGKGRGRCYGPQCLCR" or "GSGCGPCFTTDHQGARKCDDCCGGAGRGRCYGPQCLCR" or "GSGCGPCFTTDH QGARACDDCCGGAGRGRCYGPQCLCR" or "GSGCGPCFTTDHQGARRCDDCCGG
  MOD_RES (21)..(89): CONT. FROM ABOVE: AGRGRCYGPQCLCR" or "GSGCGPCFTTDHQGARKC DDCCGGRGRGRCYGPQCLCR" or "GSGCGPCFTTDHQGARACDDCCGGRGRGRCY GPQCLCR" or "GSGCGPCFTTDHQGARRCDDCCGGRGRGRCYGPQCLCR" or " GSKCGPCFTTDHQGARRCDDCCGGRGRGRCYGPQCLCR" or "GSGCGPCFTTDH
  MOD_RES (21)..(89): CONT. FROM ABOVE: QGARCDDCCGGGRGKCYGPQCLCR" or "GSGCGPCF TTDHQGARCDDCCGGGRGCYGPQCLCR" or "GSKCGPCFTTDHQGARCDDCCGGG RGCYGPQCLCR" or "GSACAPCFTTDHQAARACDDCCGGKGRGKCYGPQCLCR" or "GSACAPCFTTDHQAARRCDDCCGGKGRGKCYGPQCLCR" or "GSACAPCF
  MOD_RES (21)..(89): CONT. FROM ABOVE: TTDHQAARKCDDCCGGAGRGKCYGPQCLCR" or "GS ACAPCFTTDHQAARACDDCCGGAGRGKCYGPQCLCR" or "GSACAPCFTTDHQAA RRCDDCCGGAGRGKCYGPQCLCR" or "GSACAPCFTTDHQAARKCDDCCGGRGRG KCYGPQCLCR" or "GSACAPCFTTDHQAARACDDCCGGRGRGKCYGPQCLCR"
  MOD_RES (21)..(89): CONT. FROM ABOVE: or "GSACAPCFTTDHQAARKCDDCCGGKGRGACYGPQ CLCR" or "GSACAPCFTTDHQAARACDDCCGGKGRGACYGPQCLCR" or "GSA CAPCFTTDHQAARRCDDCCGGKGRGACYGPQCLCR" or "GSACAPCFTTDHQAAR KCDDCCGGAGRGACYGPQCLCR" or "GSACAPCFTTDHQAARACDDCCGGAGRG
  MOD_RES (21)..(89): CONT. FROM ABOVE: ACYGPQCLCR" or "GSACAPCFTTDHQAARRCDDCC GGAGRGACYGPQCLCR" or "GSACAPCFTTDHQAARKCDDCCGGRGRGACYGPQC LCR" or "GSACAPCFTTDHQAARACDDCCGGRGRGACYGPQCLCR" or "GSAC APCFTTDHQAARRCDDCCGGRGRGACYGPQCLCR" or "GSACAPCFTTDHQAAR
  MOD_RES (21)..(89): CONT. FROM ABOVE: KCDDCCGGKGRGRCYGPQCLCR" or "GSACAPCFTT DHQAARACDDCCGGKGRGRCYGPQCLCR" or "GSACAPCFTTDHQAARRCDDCCG GKGRGRCYGPQCLCR" or "GSACAPCFTTDHQAARKCDDCCGGAGRGRCYGPQCL CR" or "GSACAPCFTTDHQAARACDDCCGGAGRGRCYGPQCLCR" or "GSAC
  MOD_RES (21)..(89): CONT. FROM ABOVE: APCFTTDHQAARRCDDCCGGAGRGRCYGPQCLCR" or "GSACAPCFTTDHQAARKCDDCCGGRGRGRCYGPQCLCR" or "GSACAPCFTTD HQAARACDDCCGGRGRGRCYGPQCLCR" or "GSICIPCFTTDHQIARKCDDCCGG KGRGKCYGPQCLCR" or "GSICIPCFTTDHQIARACDDCCGGKGRGKCYGPQCL
  MOD_RES (21)..(89): CONT. FROM ABOVE: CR" or "GSICIPCFTTDHQIARRCDDCCGGKGRGKC YGPQCLCR" or "GSICIPCFTTDHQIARKCDDCCGGAGRGKCYGPQCLCR" or "GSICIPCFTTDHQIARACDDCCGGAGRGKCYGPQCLCR" or "GSICIPCFTTDH QIARRCDDCCGGAGRGKCYGPQCLCR" or "GSICIPCFTTDHQIARKCDDCCGG
  MOD_RES (21)..(89): CONT. FROM ABOVE: RGRGKCYGPQCLCR" or "GSICIPCFTTDHQIARAC DDCCGGRGRGKCYGPQCLCR" or "GSICIPCFTTDHQIARKCDDCCGGKGRGACY GPQCLCR" or "GSICIPCFTTDHQIARACDDCCGGKGRGACYGPQCLCR" or " GSICIPCFTTDHQIARRCDDCCGGKGRGACYGPQCLCR" or "GSICIPCFTTDH
  MOD_RES (21)..(89): CONT. FROM ABOVE: QIARKCDDCCGGAGRGACYGPQCLCR" or "GSICIP CFTTDHQIARACDDCCGGAGRGACYGPQCLCR" or "GSICIPCFTTDHQIARRCD DCCGGAGRGACYGPQCLCR" or "GSICIPCFTTDHQIARKCDDCCGGRGRGACYG PQCLCR" or "GSICIPCFTTDHQIARACDDCCGGRGRGACYGPQCLCR" or "
  MOD_RES (21)..(89): CONT. FROM ABOVE: GSICIPCFTTDHQIARRCDDCCGGRGRGACYGPQCLCR " or "GSICIPCFTTDHQIARKCDDCCGGKGRGRCYGPQCLCR" or "GSICIPC FTTDHQIARACDDCCGGKGRGRCYGPQCLCR" or "GSICIPCFTTDHQIARRCDD CCGGKGRGRCYGPQCLCR" or "GSICIPCFTTDHQIARKCDDCCGGAGRGRCYG
  MOD_RES (21)..(89): CONT. FROM ABOVE: PQCLCR" or "GSICIPCFTTDHQIARACDDCCGGAG RGRCYGPQCLCR" or "GSICIPCFTTDHQIARRCDDCCGGAGRGRCYGPQCLCR" or "GSICIPCFTTDHQIARKCDDCCGGRGRGRCYGPQCLCR" or "GSICIPCF TTDHQIARACDDCCGGRGRGRCYGPQCLCR" or "GSICIPCFTTDHQIARRCDD
  MOD_RES (21)..(89): CONT. FROM ABOVE: CCGGRGRGRCYGPQCLCR" or "GSKCIPCFTTDHQI ARRCDDCCGGRGRGRCYGPQCLCR" or "GSICIPCFTTDHQIARCDDCCGGGRGK CYGPQCLCR" or "GSICIPCFTTDHQIARCDDCCGGGRGCYGPQCLCR" or "G SKCIPCFTTDHQIARCDDCCGGGRGCYGPQCLCR" or "GSTCTPCFTTDHQTAR
  MOD_RES (21)..(89): CONT. FROM ABOVE: KCDDCCGGKGRGKCYGPQCLCR" or "GSTCTPCFTT DHQTARACDDCCGGKGRGKCYGPQCLCR" or "GSTCTPCFTTDHQTARRCDDCCG GKGRGKCYGPQCLCR" or "GSTCTPCFTTDHQTARKCDDCCGGAGRGKCYGPQCL CR" or "GSTCTPCFTTDHQTARACDDCCGGAGRGKCYGPQCLCR" or "GSTC
  MOD_RES (21)..(89): CONT. FROM ABOVE: TPCFTTDHQTARRCDDCCGGAGRGKCYGPQCLCR" or "GSTCTPCFTTDHQTARKCDDCCGGRGRGKCYGPQCLCR" or "GSTCTPCFTTD HQTARACDDCCGGRGRGKCYGPQCLCR" or "GSTCTPCFTTDHQTARRCDDCCGG RGRGKCYGPQCLCR" or "GSTCTPCFTTDHQTARKCDDCCGGKGRGACYGPQCL
  MOD_RES (21)..(89): CONT. FROM ABOVE: CR" or "GSTCTPCFTTDHQTARACDDCCGGKGRGAC YGPQCLCR" or "GSTCTPCFTTDHQTARRCDDCCGGKGRGACYGPQCLCR" or "GSTCTPCFTTDHQTARKCDDCCGGAGRGACYGPQCLCR" or "GSTCTPCFTTDH QTARACDDCCGGAGRGACYGPQCLCR" or "GSTCTPCFTTDHQTARRCDDCCGG
  MOD_RES (21)..(89): CONT. FROM ABOVE: AGRGACYGPQCLCR" or "GSTCTPCFTTDHQTARKC DDCCGGRGRGACYGPQCLCR" or "GSTCTPCFTTDHQTARACDDCCGGRGRGACY GPQCLCR" or "GSTCTPCFTTDHQTARRCDDCCGGRGRGACYGPQCLCR" or " GSTCTPCFTTDHQTARKCDDCCGGKGRGRCYGPQCLCR" or "GSTCTPCFTTDH
  MOD_RES (21)..(89): CONT. FROM ABOVE: QTARACDDCCGGKGRGRCYGPQCLCR" or "GSTCTP CFTTDHQTARRCDDCCGGKGRGRCYGPQCLCR" or "GSTCTPCFTTDHQTARKCD DCCGGAGRGRCYGPQCLCR" or "GSTCTPCFTTDHQTARACDDCCGGAGRGRCYG PQCLCR" or "GSTCTPCFTTDHQTARRCDDCCGGAGRGRCYGPQCLCR" or "
  MOD_RES (21)..(89): CONT. FROM ABOVE: GSTCTPCFTTDHQTARKCDDCCGGRGRGRCYGPQCLCR " or "GSTCTPCFTTDHQTARACDDCCGGRGRGRCYGPQCLCR" or "GSTCTPC FTTDHQTARRCDDCCGGRGRGRCYGPQCLCR" or "GSKCTPCFTTDHQTARRCDD CCGGRGRGRCYGPQCLCR" or "GSTCTPCFTTDHQTARCDDCCGGGRGKCYGPQ
  MOD_RES (21)..(89): CONT. FROM ABOVE: CLCR" or "GSTCTPCFTTDHQTARCDDCCGGGRGCY GPQCLCR" or "GSKCTPCFTTDHQTARCDDCCGGGRGCYGPQCLCR" or "GSV CVPCFTTDHQVARKCDDCCGGKGRGKCYGPQCLCR" or "GSVCVPCFTTDHQVAR ACDDCCGGKGRGKCYGPQCLCR" or "GSVCVPCFTTDHQVARRCDDCCGGKGRG
  MOD_RES (21)..(89): CONT. FROM ABOVE: KCYGPQCLCR" or "GSVCVPCFTTDHQVARKCDDCC GGAGRGKCYGPQCLCR" or "GSVCVPCFTTDHQVARACDDCCGGAGRGKCYGPQC LCR" or "GSVCVPCFTTDHQVARRCDDCCGGAGRGKCYGPQCLCR" or "GSVC VPCFTTDHQVARKCDDCCGGRGRGKCYGPQCLCR" or "GSVCVPCFTTDHQVAR
  MOD_RES (21)..(89): CONT. FROM ABOVE: ACDDCCGGRGRGKCYGPQCLCR" or "GSVCVPCFTT DHQVARRCDDCCGGRGRGKCYGPQCLCR" or "GSVCVPCFTTDHQVARKCDDCCG GKGRGACYGPQCLCR" or "GSVCVPCFTTDHQVARACDDCCGGKGRGACYGPQCL CR" or "GSVCVPCFTTDHQVARRCDDCCGGKGRGACYGPQCLCR" or "GSVC
  MOD_RES (21)..(89): CONT. FROM ABOVE: VPCFTTDHQVARKCDDCCGGAGRGACYGPQCLCR" or "GSVCVPCFTTDHQVARACDDCCGGAGRGACYGPQCLCR" or "GSVCVPCFTTD HQVARRCDDCCGGAGRGACYGPQCLCR" or "GSVCVPCFTTDHQVARKCDDCCGG RGRGACYGPQCLCR" or "GSVCVPCFTTDHQVARACDDCCGGRGRGACYGPQCL
  MOD_RES (21)..(89): CONT. FROM ABOVE: CR" or "GSVCVPCFTTDHQVARRCDDCCGGRGRGAC YGPQCLCR" or "GSVCVPCFTTDHQVARKCDDCCGGKGRGRCYGPQCLCR" or "GSVCVPCFTTDHQVARACDDCCGGKGRGRCYGPQCLCR" or "GSVCVPCFTTDH QVARRCDDCCGGKGRGRCYGPQCLCR" or "GSVCVPCFTTDHQVARKCDDCCGG
  MOD_RES (21)..(89): CONT. FROM ABOVE: AGRGRCYGPQCLCR" or "GSVCVPCFTTDHQVARAC DDCCGGAGRGRCYGPQCLCR" or "GSVCVPCFTTDHQVARRCDDCCGGAGRGRCY GPQCLCR" or "GSVCVPCFTTDHQVARKCDDCCGGRGRGRCYGPQCLCR" or " GSVCVPCFTTDHQVARACDDCCGGRGRGRCYGPQCLCR" or "GSVCVPCFTTDH
  MOD_RES (21)..(89): CONT. FROM ABOVE: QVARRCDDCCGGRGRGRCYGPQCLCR" or "GSKCVP CFTTDHQVARRCDDCCGGRGRGRCYGPQCLCR" or "GSVCVPCFTTDHQVARCDD CCGGGRGKCYGPQCLCR" or "GSVCVPCFTTDHQVARCDDCCGGGRGCYGPQCLC R" or "GSKCVPCFTTDHQVARCDDCCGGGRGCYGPQCLCR" or "GSLCLPCF
  MOD_RES (21)..(89): CONT. FROM ABOVE: TTDHQLARKCDDCCGGKGRGKCYGPQCLCR" or "GS LCLPCFTTDHQLARACDDCCGGKGRGKCYGPQCLCR" or "GSLCLPCFTTDHQLA RRCDDCCGGKGRGKCYGPQCLCR" or "GSLCLPCFTTDHQLARKCDDCCGGAGRG KCYGPQCLCR" or "GSLCLPCFTTDHQLARACDDCCGGAGRGKCYGPQCLCR"
  MOD_RES (21)..(89): CONT. FROM ABOVE: or "GSLCLPCFTTDHQLARRCDDCCGGAGRGKCYGPQ CLCR" or "GSLCLPCFTTDHQLARKCDDCCGGRGRGKCYGPQCLCR" or "GSL CLPCFTTDHQLARACDDCCGGRGRGKCYGPQCLCR" or "GSLCLPCFTTDHQLAR RCDDCCGGRGRGKCYGPQCLCR" or "GSLCLPCFTTDHQLARKCDDCCGGKGRG
  MOD_RES (21)..(89): CONT. FROM ABOVE: ACYGPQCLCR" or "GSLCLPCFTTDHQLARACDDCC GGKGRGACYGPQCLCR" or "GSLCLPCFTTDHQLARRCDDCCGGKGRGACYGPQC LCR" or "GSLCLPCFTTDHQLARKCDDCCGGAGRGACYGPQCLCR" or "GSLC LPCFTTDHQLARACDDCCGGAGRGACYGPQCLCR" or "GSLCLPCFTTDHQLAR
  MOD_RES (21)..(89): CONT. FROM ABOVE: RCDDCCGGAGRGACYGPQCLCR" or "GSLCLPCFTT DHQLARKCDDCCGGRGRGACYGPQCLCR" or "GSLCLPCFTTDHQLARACDDCCG GRGRGACYGPQCLCR" or "GSLCLPCFTTDHQLARRCDDCCGGRGRGACYGPQCL CR" or "GSLCLPCFTTDHQLARKCDDCCGGKGRGRCYGPQCLCR" or "GSLC
  MOD_RES (21)..(89): CONT. FROM ABOVE: LPCFTTDHQLARACDDCCGGKGRGRCYGPQCLCR" or "GSLCLPCFTTDHQLARRCDDCCGGKGRGRCYGPQCLCR" or "GSLCLPCFTTD HQLARKCDDCCGGAGRGRCYGPQCLCR" or "GSLCLPCFTTDHQLARACDDCCGG AGRGRCYGPQCLCR" or "GSLCLPCFTTDHQLARRCDDCCGGAGRGRCYGPQCL
  MOD_RES (21)..(89): CONT. FROM ABOVE: CR" or "GSLCLPCFTTDHQLARKCDDCCGGRGRGRC YGPQCLCR" or "GSLCLPCFTTDHQLARACDDCCGGRGRGRCYGPQCLCR" or "GSLCLPCFTTDHQLARRCDDCCGGRGRGRCYGPQCLCR" or "GSKCLPCFTTDH QLARRCDDCCGGRGRGRCYGPQCLCR" or "GSLCLPCFTTDHQLARCDDCCGGG
  MOD_RES (21)..(89): CONT. FROM ABOVE: RGKCYGPQCLCR" or "GSLCLPCFTTDHQLARCDDC CGGGRGCYGPQCLCR" or "GSKCLPCFTTDHQLARCDDCCGGGRGCYGPQCLCR" or "GSSCSPCFTTDHQSARKCDDCCGGKGRGKCYGPQCLCR" or "GSSCSPCF TTDHQSARACDDCCGGKGRGKCYGPQCLCR" or "GSSCSPCFTTDHQSARRCDD
  MOD_RES (21)..(89): CONT. FROM ABOVE: CCGGKGRGKCYGPQCLCR" or "GSSCSPCFTTDHQS ARKCDDCCGGAGRGKCYGPQCLCR" or "GSSCSPCFTTDHQSARACDDCCGGAGR GKCYGPQCLCR" or "GSSCSPCFTTDHQSARRCDDCCGGAGRGKCYGPQCLCR" or "GSSCSPCFTTDHQSARKCDDCCGGRGRGKCYGPQCLCR" or "GSSCSPCF
  MOD_RES (21)..(89): CONT. FROM ABOVE: TTDHQSARACDDCCGGRGRGKCYGPQCLCR" or "GS SCSPCFTTDHQSARRCDDCCGGRGRGKCYGPQCLCR" or "GSSCSPCFTTDHQSA RKCDDCCGGKGRGACYGPQCLCR" or "GSSCSPCFTTDHQSARACDDCCGGKGRG ACYGPQCLCR" or "GSSCSPCFTTDHQSARRCDDCCGGKGRGACYGPQCLCR"
  MOD_RES (21)..(89): CONT. FROM ABOVE: or "GSSCSPCFTTDHQSARKCDDCCGGAGRGACYGPQ CLCR" or "GSSCSPCFTTDHQSARACDDCCGGAGRGACYGPQCLCR" or "GSS CSPCFTTDHQSARRCDDCCGGAGRGACYGPQCLCR" or "GSSCSPCFTTDHQSAR KCDDCCGGRGRGACYGPQCLCR" or "GSSCSPCFTTDHQSARACDDCCGGRGRG
  MOD_RES (21)..(89): CONT. FROM ABOVE: ACYGPQCLCR" or "GSSCSPCFTTDHQSARRCDDCC GGRGRGACYGPQCLCR" or "GSSCSPCFTTDHQSARKCDDCCGGKGRGRCYGPQC LCR" or "GSSCSPCFTTDHQSARACDDCCGGKGRGRCYGPQCLCR" or "GSSC SPCFTTDHQSARRCDDCCGGKGRGRCYGPQCLCR" or "GSSCSPCFTTDHQSAR
  MOD_RES (21)..(89): CONT. FROM ABOVE: KCDDCCGGAGRGRCYGPQCLCR" or "GSSCSPCFTT DHQSARACDDCCGGAGRGRCYGPQCLCR" or "GSSCSPCFTTDHQSARRCDDCCG GAGRGRCYGPQCLCR" or "GSSCSPCFTTDHQSARKCDDCCGGRGRGRCYGPQCL CR" or "GSSCSPCFTTDHQSARACDDCCGGRGRGRCYGPQCLCR" or "GSSC
  MOD_RES (21)..(89): CONT. FROM ABOVE: SPCFTTDHQSARRCDDCCGGRGRGRCYGPQCLCR" or "GSKCSPCFTTDHQSARRCDDCCGGRGRGRCYGPQCLCR" or "GSSCSPCFTTD HQSARCDDCCGGGRGKCYGPQCLCR" or "GSSCSPCFTTDHQSARCDDCCGGGRG CYGPQCLCR" or "GSKCSPCFTTDHQSARCDDCCGGGRGCYGPQCLCR" or "
  MOD_RES (21)..(89): CONT. FROM ABOVE: GSMCMPCFTTDPNMARKCRDCCGGNGKCFGPQCLCNRG " or "GSMCMPCFTTDHNMAKKCRDCCGGNGKCFGYQCLCNRG" or "GSMCMPC FTTDHQTARRCRDCCGGRGRKCFGQCLCGYD" or "GSACGPCFTTDPQMAEKCSD CCGGIGTCYGPQCLCNRL" or "GSMCMPCFTTRPNMAQQCRDCCRGRGKCFGPQ
  MOD_RES (21)..(89): CONT. FROM ABOVE: CLCG" or "GSMCMPCFTTRPNMAQQCRDCCRGRGKC FGPQCLCGYD" or "GSMCMPCFTTNLNMEQECRDCCGGTGRCFGPQCLCG" or "GSGCMPCFTTDRYMARKCKECCRGYGNCFGPQCLCNRG" or "GSGCGPCFTTDA NMARKCRECCGGNGKCFGPQCLCNRE" or "GSGCGPCFTTDANMARKCRECCGG
  MOD_RES (21)..(89): CONT. FROM ABOVE: IGKCFGPQCLCNRI" or "GSMCMPCFTTRPDMAQQC RACCKGRGKCFGPQCLCG" or "GSMCIPCFTTNPNMAAKCNACCGSRRGSCRGPQ CIC" or "[sequence omitted]" or "GSCGP CFTTDPYTESKCATCCGGRGKCVGPQCLCNR" or "GSRCGPCFTTDPQTQAKCS
  MOD_RES (21)..(89): CONT. FROM ABOVE: ECCGRKGGVCKGPQCICG" or "GSCGPCFTKDPETE KKCATCCGGIGRCFGPQCLCNRG" or "GSMCMPCFTTDHQMARRCDDCCGGRGRG KCWGPQCLCR" or "GSAMCMPCFTTDHNMAKKCRDCCGGNGKCFGPQCLCNRG" or "GSCGPCFTTDWESEKKCAECCGGIGRCFGPQCLCNRK" or "GSCGPCFTT
  MOD_RES (21)..(89): CONT. FROM ABOVE: DHQTEQKCAECCGGIGKCYGPQCLCRG" or "GSCGP CFTTDRQMEQKCAECCGGIGKCYGPQCLCRG" or "GSCGPCFTTDHQTEQKCAEC CGGIGKCYGPQCLC" or "GSCMPCFTTDHQMARKCDDCCGGRGKCYGPQCLCRG" or "GSRCGPCFTTDPQTQAKCSECCGRKGGVCKGPQCICGIQ" or "GSRCPP
  MOD_RES (21)..(89): CONT. FROM ABOVE: CFTTNPNMEADCRKCCGGRGYCASYQCICPG" or "G SCGPCFTTDHNMARKCDECCGGKGRGKCFGPQCLCR" or "GSVCMPCFTTDQQMA RKCSDCCGGKGRGKCYGPQCLCR" or "GSMCGPCFTTDANMARKCRECCGGIGKC FGPQCLCNRI" or "GSMCGPCFTTDANMAAACRECCGGIGKCFGPQCLCNRI"
  MOD_RES (21)..(89): CONT. FROM ABOVE: or "GSMCGPCFTTDANMARKCAECCGGIGKCFGPQCL CNRI" or "GSMCGPCFTTDANMARKCRECCGGIGACFGPQCLCNRI" or "GSM CGPCFTTDANMARKCRECCGGIGKCFGPQCLCNAI" or "GSCMPCFTTRPNMAQQ CRDCCRGRGKCFGPQCLCGYD" or "GSMCMPCFTTNLNMEQECRDCCGGTGRCF
  MOD_RES (21)..(89): CONT. FROM ABOVE: GPQCLCGYD" or "GSCMPCFTTRPNMAQQCRDCCRG RGKCFGPQCLCGYD" or "MCMPCFTTDHQMARKCDDCCGGKGRGKCYGPQCLCR" or "MCMPCFTTDHQMARRCDDCCGGRGRGKCYGPQCLCR" or "MCMPCFTTDH QMARRCDDCCGGRGRGRCYGPQCLCR" or "MCMPCFTTDHQMARKCDDCCGGRG
  MOD_RES (21)..(89): CONT. FROM ABOVE: RGRCYGPQCLCR" or "MCMPCFTTDHQMARRCDDCC GGKGRGRCYGPQCLCR" or "MCMPCFTTHHRMAENCDICCGGDGRGKCYGPQCLC R" or "MCMPCFTTDTQMQERCDRCCGGGGRGKCWGPQCLCI" or "MCMPCFTT DTQMQERCDRCCGGGGRGRCWGPQCLCI" or "MCMPCFTTEQRMAIICDDCCGG
  MOD_RES (21)..(89): CONT. FROM ABOVE: FGRGKCYGPQCLCR" or "MCMPCFTTEQRMAIICDD CCGGFGRGRCYGPQCLCR" or "ICIPCFTTDHQIARRCDDCCGGRGRGKCYGPQC ICR" or "ICIPCFTTDHQIARRCDDCCGGRGRGRCYGPQCICR" or "MCMPCF TTDHRMAENCDICCGGDGRGKCYGPQCLCR" or "MCMPCFTTDHRMAENCDICC
  MOD_RES (21)..(89): CONT. FROM ABOVE: GGDGRGRCYGPQCLCR" or "MCMPCFTTEQRMAIIC DDCCGGFGRGKCYGPQCLCI" or "MCMPCFTTEQRMAIICDDCCGGFGRGRCYGP QCLCI" or "ICIPCFTTDHQIARRCDDCCGGRGRGKCYGPQCICI" or "ICIP CFTTDHQIARRCDDCCGGRGRGRCYGPQCICI" or "MCMPCFTTDHRMAENCDI
  MOD_RES (21)..(89): CONT. FROM ABOVE: CCGGDGRGKCYGPQCLCI" or "MCMPCFTTDHRMAE NCDICCGGDGRGRCYGPQCLCI" or "MCMPCFTTDTQMQEKCDRCCGGGGRGRCW GPQCLCI" or "MCMPCFTTEQRMAIKCDDCCGGFGRGRCYGPQCLCR" or "IC IPCFTTDHQIARKCDDCCGGRGRGRCYGPQCICR" or "MCMPCFTTDHRMAEKC
  MOD_RES (21)..(89): CONT. FROM ABOVE: DICCGGDGRGRCYGPQCLCR" or "MCMPCFTTDTQM QERCDRCCGGKGRGRCWGPQCLCI" or "MCMPCFTTEQRMAIICDDCCGGKGRGR CYGPQCLCR" or "ICIPCFTTDHQIARRCDDCCGGKGRGRCYGPQCICR" or " MCMPCFTTDHRMAENCDICCGGKGRGRCYGPQCLCR" or "MCMPCFTTHHRMAE
  MOD_RES (21)..(89): CONT. FROM ABOVE: NCDICCGGDGRGRCYGPQCLCR" or "MCMPCFTTDT QMQERCDRCCGGGGRGRCWGPQCLC" or "MCMPCFTTEQRMAIICDDCCGGFGRG RCYGPQCLC" or "ICIPCFTTDHQIARRCDDCCGGRGRGRCYGPQCIC" or "M CMPCFTTDHRMAENCDICCGGDGRGRCYGPQCLC" or "MCMPCFTTDHQMARRC
  MOD_RES (21)..(89): CONT. FROM ABOVE: DDCCGGRGRGRCYGPQCLCI" or "ACAPCFTTDHQA ARRCDDCCGGRGRGKCYGPQCLCR" or "ACAPCFTTDHQAARKCDDCCGGKGRGK CYGPQCLCR" or "MCMPCFTTHHRMAENCDICCGGDGRGKCYGPQCLCI" or " MCMPCFTTHHRMAENCDICCGGDGRGKCYGPQCLC" or "MCMPCFTTDHQMARR
  MOD_RES (21)..(89): CONT. FROM ABOVE: CDDCCGGRGRGRCYGPQCLC" or "MCMPCFTTHHQM AENCDICCGGDGRGKCYGPQCLCR" or "MCMPCFTTHHRMARNCDICCGGDGRGK CYGPQCLCR" or "MCMPCFTTHHRMAERCDICCGGDGRGKCYGPQCLCR" or " MCMPCFTTHHRMAENCDDCCGGDGRGKCYGPQCLCR" or "RCMPCFTTDHQMAR
  MOD_RES (21)..(89): CONT. FROM ABOVE: RCDDCCGGRGRGKCYGPQCLCR" or "ICIPCFTTDH QIARRCDDCCGGRGRGKCYGPQCLCR" or "MCLPCFTTDHQLARRCDDCCGGRGR GKCYGPQCLCR" or "MCMPCFTTEHQMARRCEECCGGRGRGKCYGPQCLCR" or "MCIPCFTTDHQMARRCEECCGGRGRGKCYGPQCLCR" or "ICIPCFTTDHQM
  MOD_RES (21)..(89): CONT. FROM ABOVE: ARRCDDCCGGRGDGKCYGPQCLCR" or "RCMPCFTT DHFMARFCDFCCGGRGRGKCYGPQCLCR" or "RCMPCFTTDHYMARYCDYCCGGR GRGKCYGPQCLCR" or "RCMPCFTTDHRMARRCDRCCGGRGRGKCYGPQCLCR" or "RCMPCFTTDHEMARECDECCGGRGRGKCYGPQCLCR" or "RCMPCFTTDH
  MOD_RES (21)..(89): CONT. FROM ABOVE: HMARHCDHCCGGRGRGKCYGPQCLCR" or "LCLPCF TTHHRLADQCDICCGGDGRGKCYGPQCLCR" or "ICIPCFTTEHQIARRCEECCG GRGRGKCYGPQCLCR" or "MCMPCFTTIYRMAHECDECCGGRGRGKCYGPQCLCR " or "MCMPCFTTGYRMAEYCDICCGGRGRGKCYGPQCLCR" or "MCMPCFTT
  MOD_RES (21)..(89): CONT. FROM ABOVE: HRRMANTCDACCGGRSRGKCYGPQCLCR" or "HCMP CFTTDHQMIRRCDDCCGGGSYGKCDGPQCLCF" or "DCMPCFTTDHRMADHCDIC CGGDDRGKCYGPQCLCR" or "MCMPCFTTDHEMERRCDDCCGIGGGGKCHGPQCL CG" or "MCMPCFTTSEQMFRRCDDCCGGWGDGKCNGPHCLCR" or "CGPCFT
  MOD_RES (21)..(89): CONT. FROM ABOVE: TDHQMEQKCAECCGGIGKCYGPQCLCNR" or "RCGP CFTTDPQTQAKCSECCGRKGGVCKGPQCICGIQY" or "MCMPCFTTDPNMAKKCR DCCGGNGKCFGPQCLCNR" or "MCMPCFTTDHNMAKKCNDCCGGYGKCFGPQCLC R" or "RCPPCFTTNPNMEADCRKCCGGRGYCASYQCICPGG" or "MCMPCFT
  MOD_RES (21)..(89): CONT. FROM ABOVE: TDPNMANKCRDCCGGGKKCFGPQCLCNR" or "MKFL YGVILIALFLTVMTATLSEARCGPCFTTDPQTQAKCSECCGRKGGVCKGPQCICGIQ Y" or "MCMPCFTTRPDMAQQCRACCKGRGKCFGPQCLCGYD" or "MKFLYGIV FIALFLTVMTATLSDAMCMPCFTTDHNMAKKCRDCCGGNGKCFGPQCLCNRG" or
  MOD_RES (21)..(89): CONT. FROM ABOVE:  "MCMPCFTTDHNMAKKCRDCCGGNGKCFGPQCLCNR" or "MKFLYGIVFITLFLTVMIATHTEAMCMPCFTTRPNMAQQCRDCCRGRGKCFG PQCLCGYD" or "MKFLYGIVFIALFLTVMIATHTEAMCMPCFTTRPNMAQQCRDC CRGRGKCFGPQCLCGYD" or "RCKPCFTTDPQMSKKCADCCGGKGKGKCYGPQC
  MOD_RES (21)..(89): CONT. FROM ABOVE: LC" or "MKFLYGIVFITLFLTVMIATHTEAAMCMPC FTTNLNMEQECRDCCGGTGRCFGPQCLCGYD" or "RCSPCFTTDQQMTKKCYDCC GGKGKGKCYGPQCICAPY" or "CGPCFTTDPYTESKCATCCGGRGKCVGPQCLCN RI" or "TEAMCMPCFTTDHNMAKKCRDCCGGNGKCFGYQCLCNRG" or "MKF
  MOD_RES (21)..(89): CONT. FROM ABOVE: LYGIVFIALFLTVMFATQTDGCGPCFTTDANMARKCRE CCGGIGKCFGPQCLCNRI" or "MKFLYGIVFIALFLTVMFATQTDGCGPCFTTDA NMARKCRECCGGNGKCFGPQCLCNRE" or "MKFLYGTILIAFFLTVMIATHSEAR CPPCFTTNPNMEADCRKCCGGRGYCASYQCICPGG" or "TEAMCMPCFTTRPDM
  MOD_RES (21)..(89): CONT. FROM ABOVE: AQQCRDCCGGNGKCFGYQCLCNRG" or "MKFLYGIV [sequence omitted]" or "MKFLYGIVFIALFLTVMIATHTEAMCMPCFTTRPDMAQQCRDCCGGNGKCFGYQCL CNRG" or "MKFLYGIILIALFLTVMIATHSEARCPNCFTTNPNAEADCKKCCGN
  MOD_RES (21)..(89): CONT. FROM ABOVE: RWGKCAGYQCVCPMK" or "MKFLYGIVFIALFLTGM [sequence omitted]" or "M CMPCFTTRPGMAQQCRDCCGGNGKCFGYQCLCNR" or "MCIPCFTTNPNMAAKCN ACCGSRRGSCRGPQCICR" or "MCIPCFTTNPNMAAKCNACCGSRRGSCRGPQC
  MOD_RES (21)..(89): CONT. FROM ABOVE: ICN" or "MCIPCFTTNPNMAAKCNACCGGNGSCRGP QCICN" or "MCIPCFTTNPNMAAKCNACCGSRGRGSCRGPQCICN" or "MCIP CFTTNPNMAAKCNACCGSRGRGKCRGPQCICN" or "MCIPCFTTDHQMAAKCNAC CGSRRGSCRGPQCICN" or "MCIPCFTTNHQMAAKCNACCGSRRGSCRGPQCIC
  MOD_RES (21)..(89): CONT. FROM ABOVE: N" or "MCIPCFTTNPNMARKCNACCGSRGRGSCRGP QCICN" or "MCIPCFTTNPNMAAKCNACCGGKGRGSCRGPQCICN" or "MCIP CFTTNPNMAAKCNACCGSRRGSCFGPQCICN" or "MCIPCFTTNPNMAAKCNACC GSRGRGKCFGPQCICN" or "MCIPCFTTNPNMAAKCNACCGSRGRGSCFGPQCI
  MOD_RES (21)..(89): CONT. FROM ABOVE: CN" or "MCIPCFTTNPNMAAKCNACCGSRGRGSCYG PQCICN" or "MCIPCFTTNPNMAAKCDACCGSRRGSCRGPQCICN" or "MCIP CFTTNHQMAAKCDACCGSRRGSCRGPQCICN" or "MCIPCFTTNHNMAAKCDACC GGRGRGSCRGPQCICN" or "MCIPCFTTNPNMAAKCDACCGSRGRGSCRGPQCI
  MOD_RES (21)..(89): CONT. FROM ABOVE: CN" or "MCIPCFTTNPNMAAKCDACCGGKGRGSCRG PQCICN" or "MCIPCFTTNHNMAAKCDACCGSRGRGSCRGPQCICN" or "MCI PCFTTNPNMAAKCRDCCGGRGSCRGPQCICN" or "MCMPCFTTNPNMAAKCDDCC GSRGRGSCRGPQCICN" or "MCIPCFTTNPNMAARCNACCGSRRGSCRGPQCIC
  MOD_RES (21)..(89): CONT. FROM ABOVE: " or "MCIPCFTTNPNMAAKCNACCGSRRGSCRGPQC ICI" or "MCMPCFTTDHQMARACDDCCGGKGRGKCYGPQCLCR" or "MCMPCF TTDHQMARRCDDCCGGKGRGKCYGPQCLCR" or "MCMPCFTTDHQMARKCDDCCG GAGRGKCYGPQCLCR" or "MCMPCFTTDHQMARACDDCCGGAGRGKCYGPQCLC
  MOD_RES (21)..(89): CONT. FROM ABOVE: R" or "MCMPCFTTDHQMARRCDDCCGGAGRGKCYGP QCLCR" or "MCMPCFTTDHQMARKCDDCCGGRGRGKCYGPQCLCR" or "MCMP CFTTDHQMARACDDCCGGRGRGKCYGPQCLCR" or "MCMPCFTTDHQMARKCDDC CGGKGRGACYGPQCLCR" or "MCMPCFTTDHQMARACDDCCGGKGRGACYGPQC
  MOD_RES (21)..(89): CONT. FROM ABOVE: LCR" or "MCMPCFTTDHQMARRCDDCCGGKGRGACY GPQCLCR" or "MCMPCFTTDHQMARKCDDCCGGAGRGACYGPQCLCR" or "MC MPCFTTDHQMARACDDCCGGAGRGACYGPQCLCR" or "MCMPCFTTDHQMARRCD DCCGGAGRGACYGPQCLCR" or "MCMPCFTTDHQMARKCDDCCGGRGRGACYGP
  MOD_RES (21)..(89): CONT. FROM ABOVE: QCLCR" or "MCMPCFTTDHQMARACDDCCGGRGRGA CYGPQCLCR" or "MCMPCFTTDHQMARRCDDCCGGRGRGACYGPQCLCR" or " MCMPCFTTDHQMARKCDDCCGGKGRGRCYGPQCLCR" or "MCMPCFTTDHQMARA CDDCCGGKGRGRCYGPQCLCR" or "MCMPCFTTDHQMARKCDDCCGGAGRGRCY
  MOD_RES (21)..(89): CONT. FROM ABOVE: GPQCLCR" or "MCMPCFTTDHQMARACDDCCGGAGR GRCYGPQCLCR" or "MCMPCFTTDHQMARRCDDCCGGAGRGRCYGPQCLCR" or "MCMPCFTTDHQMARACDDCCGGRGRGRCYGPQCLCR" or "KCMPCFTTDHQMA RRCDDCCGGRGRGRCYGPQCLCR" or "ACAPCFTTDHQAARRCDDCCGGRGRGR
  MOD_RES (21)..(89): CONT. FROM ABOVE: CYGPQCLCR" or "KCAPCFTTDHQAARRCDDCCGGR GRGRCYGPQCLCR" or "MCMPCFTTDHQMARCDDCCGGGRGKCYGPQCLCR" or "MCMPCFTTDHQMARCDDCCGGGRGCYGPQCLCR" or "KCMPCFTTDHQMARCD DCCGGGRGCYGPQCLCR" or "ACAPCFTTDHQAARCDDCCGGGRGKCYGPQCLC
  MOD_RES (21)..(89): CONT. FROM ABOVE: R" or "ACAPCFTTDHQAARCDDCCGGGRGCYGPQCL CR" or "KCAPCFTTDHQAARCDDCCGGGRGCYGPQCLCR" or "MCMPCFTTDH QMARKCDDCCGGKGRGKCYGPQCLCRGAGAAGG" or "MCMPCFTTDHQMARACDD CCGGKGRGKCYGPQCLCRGAGAAGG" or "MCMPCFTTDHQMARRCDDCCGGKGR
  MOD_RES (21)..(89): CONT. FROM ABOVE: GKCYGPQCLCRGAGAAGG" or "MCMPCFTTDHQMAR KCDDCCGGAGRGKCYGPQCLCRGAGAAGG" or "MCMPCFTTDHQMARACDDCCGG AGRGKCYGPQCLCRGAGAAGG" or "MCMPCFTTDHQMARRCDDCCGGAGRGKCYG PQCLCRGAGAAGG" or "MCMPCFTTDHQMARKCDDCCGGRGRGKCYGPQCLCRG
  MOD_RES (21)..(89): CONT. FROM ABOVE: AGAAGG" or "MCMPCFTTDHQMARACDDCCGGRGRG KCYGPQCLCRGAGAAGG" or "MCMPCFTTDHQMARRCDDCCGGRGRGKCYGPQCL CRGAGAAGG" or "MCMPCFTTDHQMARKCDDCCGGKGRGACYGPQCLCRGAGAAG G" or "MCMPCFTTDHQMARACDDCCGGKGRGACYGPQCLCRGAGAAGG" or "
  MOD_RES (21)..(89): CONT. FROM ABOVE: MCMPCFTTDHQMARRCDDCCGGKGRGACYGPQCLCRGA GAAGG" or "MCMPCFTTDHQMARKCDDCCGGAGRGACYGPQCLCRGAGAAGG" o r "MCMPCFTTDHQMARACDDCCGGAGRGACYGPQCLCRGAGAAGG" or "MCMPC FTTDHQMARRCDDCCGGAGRGACYGPQCLCRGAGAAGG" or "MCMPCFTTDHQM
  MOD_RES (21)..(89): CONT. FROM ABOVE: ARKCDDCCGGRGRGACYGPQCLCRGAGAAGG" or "M CMPCFTTDHQMARACDDCCGGRGRGACYGPQCLCRGAGAAGG" or "MCMPCFTTD HQMARRCDDCCGGRGRGACYGPQCLCRGAGAAGG" or "MCMPCFTTDHQMARKCD DCCGGKGRGRCYGPQCLCRGAGAAGG" or "MCMPCFTTDHQMARACDDCCGGKG
  MOD_RES (21)..(89): CONT. FROM ABOVE: RGRCYGPQCLCRGAGAAGG" or "MCMPCFTTDHQMA RRCDDCCGGKGRGRCYGPQCLCRGAGAAGG" or "MCMPCFTTDHQMARKCDDCCG GAGRGRCYGPQCLCRGAGAAGG" or "MCMPCFTTDHQMARACDDCCGGAGRGRCY GPQCLCRGAGAAGG" or "MCMPCFTTDHQMARRCDDCCGGAGRGRCYGPQCLCR
  MOD_RES (21)..(89): CONT. FROM ABOVE: GAGAAGG" or "MCMPCFTTDHQMARKCDDCCGGRGR GRCYGPQCLCRGAGAAGG" or "MCMPCFTTDHQMARACDDCCGGRGRGRCYGPQC LCRGAGAAGG" or "MCMPCFTTDHQMARRCDDCCGGRGRGRCYGPQCLCRGAGAA GG" or "KCMPCFTTDHQMARRCDDCCGGRGRGRCYGPQCLCRGAGAAGG" or
  MOD_RES (21)..(89): CONT. FROM ABOVE: "ACAPCFTTDHQAARRCDDCCGGRGRGRCYGPQCLCRG AGAAGG" or "KCAPCFTTDHQAARRCDDCCGGRGRGRCYGPQCLCRGAGAAGG" or "MCMPCFTTDHQMARCDDCCGGGRGKCYGPQCLCRGAGAAGG" or "MCMPCF TTDHQMARCDDCCGGGRGCYGPQCLCRGAGAAGG" or "KCMPCFTTDHQMARCD
  MOD_RES (21)..(89): CONT. FROM ABOVE: DCCGGGRGCYGPQCLCRGAGAAGG" or "ACAPCFTT DHQAARCDDCCGGGRGKCYGPQCLCRGAGAAGG" or "ACAPCFTTDHQAARCDDC CGGGRGCYGPQCLCRGAGAAGG" or "KCAPCFTTDHQAARCDDCCGGGRGCYGPQ CLCRGAGAAGG" or "MCMPCFTTDHQMVRKCDDCCGGKGRGKCYGPQCLCR" o
  MOD_RES (21)..(89): CONT. FROM ABOVE: r "MCMPCFTTDHQMVRVCDDCCGGKGRGKCYGPQCLC R" or "MCMPCFTTDHQMVRRCDDCCGGKGRGKCYGPQCLCR" or "MCMPCFTT DHQMVRKCDDCCGGVGRGKCYGPQCLCR" or "MCMPCFTTDHQMVRVCDDCCGGV GRGKCYGPQCLCR" or "MCMPCFTTDHQMVRRCDDCCGGVGRGKCYGPQCLCR"
  MOD_RES (21)..(89): CONT. FROM ABOVE:  or "MCMPCFTTDHQMVRKCDDCCGGRGRGKCYGPQC LCR" or "MCMPCFTTDHQMVRVCDDCCGGRGRGKCYGPQCLCR" or "MCMPCF TTDHQMVRRCDDCCGGRGRGKCYGPQCLCR" or "MCMPCFTTDHQMVRKCDDCCG GKGRGVCYGPQCLCR" or "MCMPCFTTDHQMVRVCDDCCGGKGRGVCYGPQCLC
  MOD_RES (21)..(89): CONT. FROM ABOVE: R" or "MCMPCFTTDHQMVRRCDDCCGGKGRGVCYGP QCLCR" or "MCMPCFTTDHQMVRKCDDCCGGVGRGVCYGPQCLCR" or "MCMP CFTTDHQMVRVCDDCCGGVGRGVCYGPQCLCR" or "MCMPCFTTDHQMVRRCDDC CGGVGRGVCYGPQCLCR" or "MCMPCFTTDHQMVRKCDDCCGGRGRGVCYGPQC
  MOD_RES (21)..(89): CONT. FROM ABOVE: LCR" or "MCMPCFTTDHQMVRVCDDCCGGRGRGVCY GPQCLCR" or "MCMPCFTTDHQMVRRCDDCCGGRGRGVCYGPQCLCR" or "MC MPCFTTDHQMVRKCDDCCGGKGRGRCYGPQCLCR" or "MCMPCFTTDHQMVRVCD DCCGGKGRGRCYGPQCLCR" or "MCMPCFTTDHQMVRRCDDCCGGKGRGRCYGP
  MOD_RES (21)..(89): CONT. FROM ABOVE: QCLCR" or "MCMPCFTTDHQMVRKCDDCCGGVGRGR CYGPQCLCR" or "MCMPCFTTDHQMVRVCDDCCGGVGRGRCYGPQCLCR" or " MCMPCFTTDHQMVRRCDDCCGGVGRGRCYGPQCLCR" or "MCMPCFTTDHQMVRK CDDCCGGRGRGRCYGPQCLCR" or "MCMPCFTTDHQMVRVCDDCCGGRGRGRCY
  MOD_RES (21)..(89): CONT. FROM ABOVE: GPQCLCR" or "MCMPCFTTDHQMVRRCDDCCGGRGR GRCYGPQCLCR" or "KCMPCFTTDHQMVRRCDDCCGGRGRGRCYGPQCLCR" or "VCVPCFTTDHQVVRRCDDCCGGRGRGRCYGPQCLCR" or "KCVPCFTTDHQVV RRCDDCCGGRGRGRCYGPQCLCR" or "MCMPCFTTDHQMVRCDDCCGGGRGKCY
  MOD_RES (21)..(89): CONT. FROM ABOVE: GPQCLCR" or "MCMPCFTTDHQMVRCDDCCGGGRGC YGPQCLCR" or "KCMPCFTTDHQMVRCDDCCGGGRGCYGPQCLCR" or "VCVP CFTTDHQVVRCDDCCGGGRGKCYGPQCLCR" or "VCVPCFTTDHQVVRCDDCCGG GRGCYGPQCLCR" or "KCVPCFTTDHQVVRCDDCCGGGRGCYGPQCLCR" or
  MOD_RES (21)..(89): CONT. FROM ABOVE: "MCMPCFTTDHQMVRKCDDCCGGKGRGKCYGPQCLCRG AGAAGG" or "MCMPCFTTDHQMVRVCDDCCGGKGRGKCYGPQCLCRGAGAAGG" or "MCMPCFTTDHQMVRRCDDCCGGKGRGKCYGPQCLCRGAGAAGG" or "MCMP CFTTDHQMVRKCDDCCGGVGRGKCYGPQCLCRGAGAAGG" or "MCMPCFTTDHQ
  MOD_RES (21)..(89): CONT. FROM ABOVE: MVRVCDDCCGGVGRGKCYGPQCLCRGAGAAGG" or " MCMPCFTTDHQMVRRCDDCCGGVGRGKCYGPQCLCRGAGAAGG" or "MCMPCFTT DHQMVRKCDDCCGGRGRGKCYGPQCLCRGAGAAGG" or "MCMPCFTTDHQMVRVC DDCCGGRGRGKCYGPQCLCRGAGAAGG" or "MCMPCFTTDHQMVRRCDDCCGGR
  MOD_RES (21)..(89): CONT. FROM ABOVE: GRGKCYGPQCLCRGAGAAGG" or "MCMPCFTTDHQM VRKCDDCCGGKGRGVCYGPQCLCRGAGAAGG" or "MCMPCFTTDHQMVRVCDDCC GGKGRGVCYGPQCLCRGAGAAGG" or "MCMPCFTTDHQMVRRCDDCCGGKGRGVC YGPQCLCRGAGAAGG" or "MCMPCFTTDHQMVRKCDDCCGGVGRGVCYGPQCLC
  MOD_RES (21)..(89): CONT. FROM ABOVE: RGAGAAGG" or "MCMPCFTTDHQMVRVCDDCCGGVG RGVCYGPQCLCRGAGAAGG" or "MCMPCFTTDHQMVRRCDDCCGGVGRGVCYGPQ CLCRGAGAAGG" or "MCMPCFTTDHQMVRKCDDCCGGRGRGVCYGPQCLCRGAGA AGG" or "MCMPCFTTDHQMVRVCDDCCGGRGRGVCYGPQCLCRGAGAAGG" or
  MOD_RES (21)..(89): CONT. FROM ABOVE:  "MCMPCFTTDHQMVRRCDDCCGGRGRGVCYGPQCLCR GAGAAGG" or "MCMPCFTTDHQMVRKCDDCCGGKGRGRCYGPQCLCRGAGAAGG" or "MCMPCFTTDHQMVRVCDDCCGGKGRGRCYGPQCLCRGAGAAGG" or "MCM PCFTTDHQMVRRCDDCCGGKGRGRCYGPQCLCRGAGAAGG" or "MCMPCFTTDH
  MOD_RES (21)..(89): CONT. FROM ABOVE: QMVRKCDDCCGGVGRGRCYGPQCLCRGAGAAGG" or "MCMPCFTTDHQMVRVCDDCCGGVGRGRCYGPQCLCRGAGAAGG" or "MCMPCFT TDHQMVRRCDDCCGGVGRGRCYGPQCLCRGAGAAGG" or "MCMPCFTTDHQMVRK CDDCCGGRGRGRCYGPQCLCRGAGAAGG" or "MCMPCFTTDHQMVRVCDDCCGG
  MOD_RES (21)..(89): CONT. FROM ABOVE: RGRGRCYGPQCLCRGAGAAGG" or "MCMPCFTTDHQ MVRRCDDCCGGRGRGRCYGPQCLCRGAGAAGG" or "KCMPCFTTDHQMVRRCDDC CGGRGRGRCYGPQCLCRGAGAAGG" or "VCVPCFTTDHQVVRRCDDCCGGRGRGR CYGPQCLCRGAGAAGG" or "KCVPCFTTDHQVVRRCDDCCGGRGRGRCYGPQCL
  MOD_RES (21)..(89): CONT. FROM ABOVE: CRGAGAAGG" or "MCMPCFTTDHQMVRCDDCCGGGR GKCYGPQCLCRGAGAAGG" or "MCMPCFTTDHQMVRCDDCCGGGRGCYGPQCLCR GAGAAGG" or "KCMPCFTTDHQMVRCDDCCGGGRGCYGPQCLCRGAGAAGG" or "VCVPCFTTDHQVVRCDDCCGGGRGKCYGPQCLCRGAGAAGG" or "VCVPCFT
  MOD_RES (21)..(89): CONT. FROM ABOVE: TDHQVVRCDDCCGGGRGCYGPQCLCRGAGAAGG" or "KCVPCFTTDHQVVRCDDCCGGGRGCYGPQCLCRGAGAAGG" or "MCMPCFTTDH QMLRKCDDCCGGKGRGKCYGPQCLCR" or "MCMPCFTTDHQMLRLCDDCCGGKGR GKCYGPQCLCR" or "MCMPCFTTDHQMLRRCDDCCGGKGRGKCYGPQCLCR" o
  MOD_RES (21)..(89): CONT. FROM ABOVE: r "MCMPCFTTDHQMLRKCDDCCGGLGRGKCYGPQCLC R" or "MCMPCFTTDHQMLRLCDDCCGGLGRGKCYGPQCLCR" or "MCMPCFTT DHQMLRRCDDCCGGLGRGKCYGPQCLCR" or "MCMPCFTTDHQMLRKCDDCCGGR GRGKCYGPQCLCR" or "MCMPCFTTDHQMLRLCDDCCGGRGRGKCYGPQCLCR"
  MOD_RES (21)..(89): CONT. FROM ABOVE:  or "MCMPCFTTDHQMLRRCDDCCGGRGRGKCYGPQC LCR" or "MCMPCFTTDHQMLRKCDDCCGGKGRGLCYGPQCLCR" or "MCMPCF TTDHQMLRLCDDCCGGKGRGLCYGPQCLCR" or "MCMPCFTTDHQMLRRCDDCCG GKGRGLCYGPQCLCR" or "MCMPCFTTDHQMLRKCDDCCGGLGRGLCYGPQCLC
  MOD_RES (21)..(89): CONT. FROM ABOVE: R" or "MCMPCFTTDHQMLRLCDDCCGGLGRGLCYGP QCLCR" or "MCMPCFTTDHQMLRRCDDCCGGLGRGLCYGPQCLCR" or "MCMP CFTTDHQMLRKCDDCCGGRGRGLCYGPQCLCR" or "MCMPCFTTDHQMLRLCDDC CGGRGRGLCYGPQCLCR" or "MCMPCFTTDHQMLRRCDDCCGGRGRGLCYGPQC
  MOD_RES (21)..(89): CONT. FROM ABOVE: LCR" or "MCMPCFTTDHQMLRKCDDCCGGKGRGRCY GPQCLCR" or "MCMPCFTTDHQMLRLCDDCCGGKGRGRCYGPQCLCR" or "MC MPCFTTDHQMLRRCDDCCGGKGRGRCYGPQCLCR" or "MCMPCFTTDHQMLRKCD DCCGGLGRGRCYGPQCLCR" or "MCMPCFTTDHQMLRLCDDCCGGLGRGRCYGP
  MOD_RES (21)..(89): CONT. FROM ABOVE: QCLCR" or "MCMPCFTTDHQMLRRCDDCCGGLGRGR CYGPQCLCR" or "MCMPCFTTDHQMLRKCDDCCGGRGRGRCYGPQCLCR" or " MCMPCFTTDHQMLRLCDDCCGGRGRGRCYGPQCLCR" or "MCMPCFTTDHQMLRR CDDCCGGRGRGRCYGPQCLCR" or "KCMPCFTTDHQMLRRCDDCCGGRGRGRCY
  MOD_RES (21)..(89): CONT. FROM ABOVE: GPQCLCR" or "LCLPCFTTDHQLLRRCDDCCGGRGR GRCYGPQCLCR" or "KCLPCFTTDHQLLRRCDDCCGGRGRGRCYGPQCLCR" or "MCMPCFTTDHQMLRCDDCCGGGRGKCYGPQCLCR" or "MCMPCFTTDHQMLRC DDCCGGGRGCYGPQCLCR" or "KCMPCFTTDHQMLRCDDCCGGGRGCYGPQCLC
  MOD_RES (21)..(89): CONT. FROM ABOVE: R" or "LCLPCFTTDHQLLRCDDCCGGGRGKCYGPQC LCR" or "LCLPCFTTDHQLLRCDDCCGGGRGCYGPQCLCR" or "KCLPCFTTD HQLLRCDDCCGGGRGCYGPQCLCR" or "MCMPCFTTDHQMLRKCDDCCGGKGRGK CYGPQCLCRGAGAAGG" or "MCMPCFTTDHQMLRLCDDCCGGKGRGKCYGPQCL
  MOD_RES (21)..(89): CONT. FROM ABOVE: CRGAGAAGG" or "MCMPCFTTDHQMLRRCDDCCGGK GRGKCYGPQCLCRGAGAAGG" or "MCMPCFTTDHQMLRKCDDCCGGLGRGKCYGP QCLCRGAGAAGG" or "MCMPCFTTDHQMLRLCDDCCGGLGRGKCYGPQCLCRGAG AAGG" or "MCMPCFTTDHQMLRRCDDCCGGLGRGKCYGPQCLCRGAGAAGG" o
  MOD_RES (21)..(89): CONT. FROM ABOVE: r "MCMPCFTTDHQMLRKCDDCCGGRGRGKCYGPQCLC RGAGAAGG" or "MCMPCFTTDHQMLRLCDDCCGGRGRGKCYGPQCLCRGAGAAGG " or "MCMPCFTTDHQMLRRCDDCCGGRGRGKCYGPQCLCRGAGAAGG" or "MC MPCFTTDHQMLRKCDDCCGGKGRGLCYGPQCLCRGAGAAGG" or "MCMPCFTTD
  MOD_RES (21)..(89): CONT. FROM ABOVE: HQMLRLCDDCCGGKGRGLCYGPQCLCRGAGAAGG" or "MCMPCFTTDHQMLRRCDDCCGGKGRGLCYGPQCLCRGAGAAGG" or "MCMPCF TTDHQMLRKCDDCCGGLGRGLCYGPQCLCRGAGAAGG" or "MCMPCFTTDHQMLR LCDDCCGGLGRGLCYGPQCLCRGAGAAGG" or "MCMPCFTTDHQMLRRCDDCCG
  MOD_RES (21)..(89): CONT. FROM ABOVE: GLGRGLCYGPQCLCRGAGAAGG" or "MCMPCFTTDH QMLRKCDDCCGGRGRGLCYGPQCLCRGAGAAGG" or "MCMPCFTTDHQMLRLCDD CCGGRGRGLCYGPQCLCRGAGAAGG" or "MCMPCFTTDHQMLRRCDDCCGGRGRG LCYGPQCLCRGAGAAGG" or "MCMPCFTTDHQMLRKCDDCCGGKGRGRCYGPQC
  MOD_RES (21)..(89): CONT. FROM ABOVE: LCRGAGAAGG" or "MCMPCFTTDHQMLRLCDDCCGG KGRGRCYGPQCLCRGAGAAGG" or "MCMPCFTTDHQMLRRCDDCCGGKGRGRCYG PQCLCRGAGAAGG" or "MCMPCFTTDHQMLRKCDDCCGGLGRGRCYGPQCLCRGA GAAGG" or "MCMPCFTTDHQMLRLCDDCCGGLGRGRCYGPQCLCRGAGAAGG"
  MOD_RES (21)..(89): CONT. FROM ABOVE: or "MCMPCFTTDHQMLRRCDDCCGGLGRGRCYGPQCL CRGAGAAGG" or "MCMPCFTTDHQMLRKCDDCCGGRGRGRCYGPQCLCRGAGAAG G" or "MCMPCFTTDHQMLRLCDDCCGGRGRGRCYGPQCLCRGAGAAGG" or "M CMPCFTTDHQMLRRCDDCCGGRGRGRCYGPQCLCRGAGAAGG" or "KCMPCFTT
  MOD_RES (21)..(89): CONT. FROM ABOVE: DHQMLRRCDDCCGGRGRGRCYGPQCLCRGAGAAGG" o r "LCLPCFTTDHQLLRRCDDCCGGRGRGRCYGPQCLCRGAGAAGG" or "KCLPC FTTDHQLLRRCDDCCGGRGRGRCYGPQCLCRGAGAAGG" or "MCMPCFTTDHQML RCDDCCGGGRGKCYGPQCLCRGAGAAGG" or "MCMPCFTTDHQMLRCDDCCGGG
  MOD_RES (21)..(89): CONT. FROM ABOVE: RGCYGPQCLCRGAGAAGG" or "KCMPCFTTDHQMLR CDDCCGGGRGCYGPQCLCRGAGAAGG" or "LCLPCFTTDHQLLRCDDCCGGGRGK CYGPQCLCRGAGAAGG" or "LCLPCFTTDHQLLRCDDCCGGGRGCYGPQCLCRGA GAAGG" or "KCLPCFTTDHQLLRCDDCCGGGRGCYGPQCLCRGAGAAGG" or
  MOD_RES (21)..(89): CONT. FROM ABOVE: "GCGPCFTTDHQGARKCDDCCGGKGRGKCYGPQCLCR" or "GCGPCFTTDHQGARACDDCCGGKGRGKCYGPQCLCR" or "GCGPCFTTDH QGARRCDDCCGGKGRGKCYGPQCLCR" or "GCGPCFTTDHQGARKCDDCCGGAGR GKCYGPQCLCR" or "GCGPCFTTDHQGARACDDCCGGAGRGKCYGPQCLCR" or
  MOD_RES (21)..(89): CONT. FROM ABOVE:  "GCGPCFTTDHQGARRCDDCCGGAGRGKCYGPQCLCR " or "GCGPCFTTDHQGARKCDDCCGGRGRGKCYGPQCLCR" or "GCGPCFTTD HQGARACDDCCGGRGRGKCYGPQCLCR" or "GCGPCFTTDHQGARRCDDCCGGRG RGKCYGPQCLCR" or "GCGPCFTTDHQGARKCDDCCGGKGRGACYGPQCLCR"
  MOD_RES (21)..(89): CONT. FROM ABOVE: or "GCGPCFTTDHQGARACDDCCGGKGRGACYGPQCL CR" or "GCGPCFTTDHQGARRCDDCCGGKGRGACYGPQCLCR" or "GCGPCFT TDHQGARKCDDCCGGAGRGACYGPQCLCR" or "GCGPCFTTDHQGARACDDCCGG AGRGACYGPQCLCR" or "GCGPCFTTDHQGARRCDDCCGGAGRGACYGPQCLCR
  MOD_RES (21)..(89): CONT. FROM ABOVE: " or "GCGPCFTTDHQGARKCDDCCGGRGRGACYGPQ CLCR" or "GCGPCFTTDHQGARACDDCCGGRGRGACYGPQCLCR" or "GCGPC FTTDHQGARRCDDCCGGRGRGACYGPQCLCR" or "GCGPCFTTDHQGARKCDDCC GGKGRGRCYGPQCLCR" or "GCGPCFTTDHQGARACDDCCGGKGRGRCYGPQCL
  MOD_RES (21)..(89): CONT. FROM ABOVE: CR" or "GCGPCFTTDHQGARRCDDCCGGKGRGRCYG PQCLCR" or "GCGPCFTTDHQGARKCDDCCGGAGRGRCYGPQCLCR" or "GCG PCFTTDHQGARACDDCCGGAGRGRCYGPQCLCR" or "GCGPCFTTDHQGARRCDD CCGGAGRGRCYGPQCLCR" or "GCGPCFTTDHQGARKCDDCCGGRGRGRCYGPQ
  MOD_RES (21)..(89): CONT. FROM ABOVE: CLCR" or "GCGPCFTTDHQGARACDDCCGGRGRGRC YGPQCLCR" or "GCGPCFTTDHQGARRCDDCCGGRGRGRCYGPQCLCR" or "K CGPCFTTDHQGARRCDDCCGGRGRGRCYGPQCLCR" or "GCGPCFTTDHQGARCD DCCGGGRGKCYGPQCLCR" or "GCGPCFTTDHQGARCDDCCGGGRGCYGPQCLC
  MOD_RES (21)..(89): CONT. FROM ABOVE: R" or "KCGPCFTTDHQGARCDDCCGGGRGCYGPQCL CR" or "ACAPCFTTDHQAARACDDCCGGKGRGKCYGPQCLCR" or "ACAPCFT TDHQAARRCDDCCGGKGRGKCYGPQCLCR" or "ACAPCFTTDHQAARKCDDCCGG AGRGKCYGPQCLCR" or "ACAPCFTTDHQAARACDDCCGGAGRGKCYGPQCLCR
  MOD_RES (21)..(89): CONT. FROM ABOVE: " or "ACAPCFTTDHQAARRCDDCCGGAGRGKCYGPQ CLCR" or "ACAPCFTTDHQAARKCDDCCGGRGRGKCYGPQCLCR" or "ACAPC FTTDHQAARACDDCCGGRGRGKCYGPQCLCR" or "ACAPCFTTDHQAARKCDDCC GGKGRGACYGPQCLCR" or "ACAPCFTTDHQAARACDDCCGGKGRGACYGPQCL
  MOD_RES (21)..(89): CONT. FROM ABOVE: CR" or "ACAPCFTTDHQAARRCDDCCGGKGRGACYG PQCLCR" or "ACAPCFTTDHQAARKCDDCCGGAGRGACYGPQCLCR" or "ACA PCFTTDHQAARACDDCCGGAGRGACYGPQCLCR" or "ACAPCFTTDHQAARRCDD CCGGAGRGACYGPQCLCR" or "ACAPCFTTDHQAARKCDDCCGGRGRGACYGPQ
  MOD_RES (21)..(89): CONT. FROM ABOVE: CLCR" or "ACAPCFTTDHQAARACDDCCGGRGRGAC YGPQCLCR" or "ACAPCFTTDHQAARRCDDCCGGRGRGACYGPQCLCR" or "A CAPCFTTDHQAARKCDDCCGGKGRGRCYGPQCLCR" or "ACAPCFTTDHQAARAC DDCCGGKGRGRCYGPQCLCR" or "ACAPCFTTDHQAARRCDDCCGGKGRGRCYG
  MOD_RES (21)..(89): CONT. FROM ABOVE: PQCLCR" or "ACAPCFTTDHQAARKCDDCCGGAGRG RCYGPQCLCR" or "ACAPCFTTDHQAARACDDCCGGAGRGRCYGPQCLCR" or "ACAPCFTTDHQAARRCDDCCGGAGRGRCYGPQCLCR" or "ACAPCFTTDHQAAR KCDDCCGGRGRGRCYGPQCLCR" or "ACAPCFTTDHQAARACDDCCGGRGRGRC
  MOD_RES (21)..(89): CONT. FROM ABOVE: YGPQCLCR" or "ICIPCFTTDHQIARKCDDCCGGKG RGKCYGPQCLCR" or "ICIPCFTTDHQIARACDDCCGGKGRGKCYGPQCLCR" o r "ICIPCFTTDHQIARRCDDCCGGKGRGKCYGPQCLCR" or "ICIPCFTTDHQI ARKCDDCCGGAGRGKCYGPQCLCR" or "ICIPCFTTDHQIARACDDCCGGAGRG
  MOD_RES (21)..(89): CONT. FROM ABOVE: KCYGPQCLCR" or "ICIPCFTTDHQIARRCDDCCGG AGRGKCYGPQCLCR" or "ICIPCFTTDHQIARKCDDCCGGRGRGKCYGPQCLCR" or "ICIPCFTTDHQIARACDDCCGGRGRGKCYGPQCLCR" or "ICIPCFTTDH QIARKCDDCCGGKGRGACYGPQCLCR" or "ICIPCFTTDHQIARACDDCCGGKG
  MOD_RES (21)..(89): CONT. FROM ABOVE: RGACYGPQCLCR" or "ICIPCFTTDHQIARRCDDCC GGKGRGACYGPQCLCR" or "ICIPCFTTDHQIARKCDDCCGGAGRGACYGPQCLC R" or "ICIPCFTTDHQIARACDDCCGGAGRGACYGPQCLCR" or "ICIPCFTT DHQIARRCDDCCGGAGRGACYGPQCLCR" or "ICIPCFTTDHQIARKCDDCCGG
  MOD_RES (21)..(89): CONT. FROM ABOVE: RGRGACYGPQCLCR" or "ICIPCFTTDHQIARACDD CCGGRGRGACYGPQCLCR" or "ICIPCFTTDHQIARRCDDCCGGRGRGACYGPQC LCR" or "ICIPCFTTDHQIARKCDDCCGGKGRGRCYGPQCLCR" or "ICIPCF TTDHQIARACDDCCGGKGRGRCYGPQCLCR" or "ICIPCFTTDHQIARRCDDCC
  MOD_RES (21)..(89): CONT. FROM ABOVE: GGKGRGRCYGPQCLCR" or "ICIPCFTTDHQIARKC DDCCGGAGRGRCYGPQCLCR" or "ICIPCFTTDHQIARACDDCCGGAGRGRCYGP QCLCR" or "ICIPCFTTDHQIARRCDDCCGGAGRGRCYGPQCLCR" or "ICIP CFTTDHQIARKCDDCCGGRGRGRCYGPQCLCR" or "ICIPCFTTDHQIARACDD
  MOD_RES (21)..(89): CONT. FROM ABOVE: CCGGRGRGRCYGPQCLCR" or "ICIPCFTTDHQIAR RCDDCCGGRGRGRCYGPQCLCR" or "KCIPCFTTDHQIARRCDDCCGGRGRGRCY GPQCLCR" or "ICIPCFTTDHQIARCDDCCGGGRGKCYGPQCLCR" or "ICIP CFTTDHQIARCDDCCGGGRGCYGPQCLCR" or "KCIPCFTTDHQIARCDDCCGG
  MOD_RES (21)..(89): CONT. FROM ABOVE: GRGCYGPQCLCR" or "TCTPCFTTDHQTARKCDDCC GGKGRGKCYGPQCLCR" or "TCTPCFTTDHQTARACDDCCGGKGRGKCYGPQCLC R" or "TCTPCFTTDHQTARRCDDCCGGKGRGKCYGPQCLCR" or "TCTPCFTT DHQTARKCDDCCGGAGRGKCYGPQCLCR" or "TCTPCFTTDHQTARACDDCCGG
  MOD_RES (21)..(89): CONT. FROM ABOVE: AGRGKCYGPQCLCR" or "TCTPCFTTDHQTARRCDD CCGGAGRGKCYGPQCLCR" or "TCTPCFTTDHQTARKCDDCCGGRGRGKCYGPQC LCR" or "TCTPCFTTDHQTARACDDCCGGRGRGKCYGPQCLCR" or "TCTPCF TTDHQTARRCDDCCGGRGRGKCYGPQCLCR" or "TCTPCFTTDHQTARKCDDCC
  MOD_RES (21)..(89): CONT. FROM ABOVE: GGKGRGACYGPQCLCR" or "TCTPCFTTDHQTARAC DDCCGGKGRGACYGPQCLCR" or "TCTPCFTTDHQTARRCDDCCGGKGRGACYGP QCLCR" or "TCTPCFTTDHQTARKCDDCCGGAGRGACYGPQCLCR" or "TCTP CFTTDHQTARACDDCCGGAGRGACYGPQCLCR" or "TCTPCFTTDHQTARRCDD
  MOD_RES (21)..(89): CONT. FROM ABOVE: CCGGAGRGACYGPQCLCR" or "TCTPCFTTDHQTAR KCDDCCGGRGRGACYGPQCLCR" or "TCTPCFTTDHQTARACDDCCGGRGRGACY GPQCLCR" or "TCTPCFTTDHQTARRCDDCCGGRGRGACYGPQCLCR" or "TC TPCFTTDHQTARKCDDCCGGKGRGRCYGPQCLCR" or "TCTPCFTTDHQTARAC
  MOD_RES (21)..(89): CONT. FROM ABOVE: DDCCGGKGRGRCYGPQCLCR" or "TCTPCFTTDHQT ARRCDDCCGGKGRGRCYGPQCLCR" or "TCTPCFTTDHQTARKCDDCCGGAGRGR CYGPQCLCR" or "TCTPCFTTDHQTARACDDCCGGAGRGRCYGPQCLCR" or " TCTPCFTTDHQTARRCDDCCGGAGRGRCYGPQCLCR" or "TCTPCFTTDHQTAR
  MOD_RES (21)..(89): CONT. FROM ABOVE: KCDDCCGGRGRGRCYGPQCLCR" or "TCTPCFTTDH QTARACDDCCGGRGRGRCYGPQCLCR" or "TCTPCFTTDHQTARRCDDCCGGRGR GRCYGPQCLCR" or "KCTPCFTTDHQTARRCDDCCGGRGRGRCYGPQCLCR" or "TCTPCFTTDHQTARCDDCCGGGRGKCYGPQCLCR" or "TCTPCFTTDHQTAR
  MOD_RES (21)..(89): CONT. FROM ABOVE: CDDCCGGGRGCYGPQCLCR" or "KCTPCFTTDHQTA RCDDCCGGGRGCYGPQCLCR" or "VCVPCFTTDHQVARKCDDCCGGKGRGKCYGP QCLCR" or "VCVPCFTTDHQVARACDDCCGGKGRGKCYGPQCLCR" or "VCVP CFTTDHQVARRCDDCCGGKGRGKCYGPQCLCR" or "VCVPCFTTDHQVARKCDD
  MOD_RES (21)..(89): CONT. FROM ABOVE: CCGGAGRGKCYGPQCLCR" or "VCVPCFTTDHQVAR ACDDCCGGAGRGKCYGPQCLCR" or "VCVPCFTTDHQVARRCDDCCGGAGRGKCY GPQCLCR" or "VCVPCFTTDHQVARKCDDCCGGRGRGKCYGPQCLCR" or "VC VPCFTTDHQVARACDDCCGGRGRGKCYGPQCLCR" or "VCVPCFTTDHQVARRC
  MOD_RES (21)..(89): CONT. FROM ABOVE: DDCCGGRGRGKCYGPQCLCR" or "VCVPCFTTDHQV ARKCDDCCGGKGRGACYGPQCLCR" or "VCVPCFTTDHQVARACDDCCGGKGRGA CYGPQCLCR" or "VCVPCFTTDHQVARRCDDCCGGKGRGACYGPQCLCR" or " VCVPCFTTDHQVARKCDDCCGGAGRGACYGPQCLCR" or "VCVPCFTTDHQVAR
  MOD_RES (21)..(89): CONT. FROM ABOVE: ACDDCCGGAGRGACYGPQCLCR" or "VCVPCFTTDH QVARRCDDCCGGAGRGACYGPQCLCR" or "VCVPCFTTDHQVARKCDDCCGGRGR GACYGPQCLCR" or "VCVPCFTTDHQVARACDDCCGGRGRGACYGPQCLCR" or "VCVPCFTTDHQVARRCDDCCGGRGRGACYGPQCLCR" or "VCVPCFTTDHQV
  MOD_RES (21)..(89): CONT. FROM ABOVE: ARKCDDCCGGKGRGRCYGPQCLCR" or "VCVPCFTT DHQVARACDDCCGGKGRGRCYGPQCLCR" or "VCVPCFTTDHQVARRCDDCCGGK GRGRCYGPQCLCR" or "VCVPCFTTDHQVARKCDDCCGGAGRGRCYGPQCLCR" or "VCVPCFTTDHQVARACDDCCGGAGRGRCYGPQCLCR" or "VCVPCFTTDH
  MOD_RES (21)..(89): CONT. FROM ABOVE: QVARRCDDCCGGAGRGRCYGPQCLCR" or "VCVPCF TTDHQVARKCDDCCGGRGRGRCYGPQCLCR" or "VCVPCFTTDHQVARACDDCCG GRGRGRCYGPQCLCR" or "VCVPCFTTDHQVARRCDDCCGGRGRGRCYGPQCLCR " or "KCVPCFTTDHQVARRCDDCCGGRGRGRCYGPQCLCR" or "VCVPCFTT
  MOD_RES (21)..(89): CONT. FROM ABOVE: DHQVARCDDCCGGGRGKCYGPQCLCR" or "VCVPCF TTDHQVARCDDCCGGGRGCYGPQCLCR" or "KCVPCFTTDHQVARCDDCCGGGRG CYGPQCLCR" or "LCLPCFTTDHQLARKCDDCCGGKGRGKCYGPQCLCR" or " LCLPCFTTDHQLARACDDCCGGKGRGKCYGPQCLCR" or "LCLPCFTTDHQLAR
  MOD_RES (21)..(89): CONT. FROM ABOVE: RCDDCCGGKGRGKCYGPQCLCR" or "LCLPCFTTDH QLARKCDDCCGGAGRGKCYGPQCLCR" or "LCLPCFTTDHQLARACDDCCGGAGR GKCYGPQCLCR" or "LCLPCFTTDHQLARRCDDCCGGAGRGKCYGPQCLCR" or "LCLPCFTTDHQLARKCDDCCGGRGRGKCYGPQCLCR" or "LCLPCFTTDHQL
  MOD_RES (21)..(89): CONT. FROM ABOVE: ARACDDCCGGRGRGKCYGPQCLCR" or "LCLPCFTT DHQLARRCDDCCGGRGRGKCYGPQCLCR" or "LCLPCFTTDHQLARKCDDCCGGK GRGACYGPQCLCR" or "LCLPCFTTDHQLARACDDCCGGKGRGACYGPQCLCR" or "LCLPCFTTDHQLARRCDDCCGGKGRGACYGPQCLCR" or "LCLPCFTTDH
  MOD_RES (21)..(89): CONT. FROM ABOVE: QLARKCDDCCGGAGRGACYGPQCLCR" or "LCLPCF TTDHQLARACDDCCGGAGRGACYGPQCLCR" or "LCLPCFTTDHQLARRCDDCCG GAGRGACYGPQCLCR" or "LCLPCFTTDHQLARKCDDCCGGRGRGACYGPQCLCR " or "LCLPCFTTDHQLARACDDCCGGRGRGACYGPQCLCR" or "LCLPCFTT
  MOD_RES (21)..(89): CONT. FROM ABOVE: DHQLARRCDDCCGGRGRGACYGPQCLCR" or "LCLP CFTTDHQLARKCDDCCGGKGRGRCYGPQCLCR" or "LCLPCFTTDHQLARACDDC CGGKGRGRCYGPQCLCR" or "LCLPCFTTDHQLARRCDDCCGGKGRGRCYGPQCL CR" or "LCLPCFTTDHQLARKCDDCCGGAGRGRCYGPQCLCR" or "LCLPCF
  MOD_RES (21)..(89): CONT. FROM ABOVE: TTDHQLARACDDCCGGAGRGRCYGPQCLCR" or "LC LPCFTTDHQLARRCDDCCGGAGRGRCYGPQCLCR" or "LCLPCFTTDHQLARKCD DCCGGRGRGRCYGPQCLCR" or "LCLPCFTTDHQLARACDDCCGGRGRGRCYGPQ CLCR" or "LCLPCFTTDHQLARRCDDCCGGRGRGRCYGPQCLCR" or "KCLP
  MOD_RES (21)..(89): CONT. FROM ABOVE: CFTTDHQLARRCDDCCGGRGRGRCYGPQCLCR" or " LCLPCFTTDHQLARCDDCCGGGRGKCYGPQCLCR" or "LCLPCFTTDHQLARCDD CCGGGRGCYGPQCLCR" or "KCLPCFTTDHQLARCDDCCGGGRGCYGPQCLCR" or "SCSPCFTTDHQSARKCDDCCGGKGRGKCYGPQCLCR" or "SCSPCFTTDH
  MOD_RES (21)..(89): CONT. FROM ABOVE: QSARACDDCCGGKGRGKCYGPQCLCR" or "SCSPCF TTDHQSARRCDDCCGGKGRGKCYGPQCLCR" or "SCSPCFTTDHQSARKCDDCCG GAGRGKCYGPQCLCR" or "SCSPCFTTDHQSARACDDCCGGAGRGKCYGPQCLCR " or "SCSPCFTTDHQSARRCDDCCGGAGRGKCYGPQCLCR" or "SCSPCFTT
  MOD_RES (21)..(89): CONT. FROM ABOVE: DHQSARKCDDCCGGRGRGKCYGPQCLCR" or "SCSP CFTTDHQSARACDDCCGGRGRGKCYGPQCLCR" or "SCSPCFTTDHQSARRCDDC CGGRGRGKCYGPQCLCR" or "SCSPCFTTDHQSARKCDDCCGGKGRGACYGPQCL CR" or "SCSPCFTTDHQSARACDDCCGGKGRGACYGPQCLCR" or "SCSPCF
  MOD_RES (21)..(89): CONT. FROM ABOVE: TTDHQSARRCDDCCGGKGRGACYGPQCLCR" or "SC SPCFTTDHQSARKCDDCCGGAGRGACYGPQCLCR" or "SCSPCFTTDHQSARACD DCCGGAGRGACYGPQCLCR" or "SCSPCFTTDHQSARRCDDCCGGAGRGACYGPQ CLCR" or "SCSPCFTTDHQSARKCDDCCGGRGRGACYGPQCLCR" or "SCSP
  MOD_RES (21)..(89): CONT. FROM ABOVE: CFTTDHQSARACDDCCGGRGRGACYGPQCLCR" or " SCSPCFTTDHQSARRCDDCCGGRGRGACYGPQCLCR" or "SCSPCFTTDHQSARK CDDCCGGKGRGRCYGPQCLCR" or "SCSPCFTTDHQSARACDDCCGGKGRGRCYG PQCLCR" or "SCSPCFTTDHQSARRCDDCCGGKGRGRCYGPQCLCR" or "SC
  MOD_RES (21)..(89): CONT. FROM ABOVE: SPCFTTDHQSARKCDDCCGGAGRGRCYGPQCLCR" or "SCSPCFTTDHQSARACDDCCGGAGRGRCYGPQCLCR" or "SCSPCFTTDHQSA RRCDDCCGGAGRGRCYGPQCLCR" or "SCSPCFTTDHQSARKCDDCCGGRGRGRC YGPQCLCR" or "SCSPCFTTDHQSARACDDCCGGRGRGRCYGPQCLCR" or "
  MOD_RES (21)..(89): CONT. FROM ABOVE: SCSPCFTTDHQSARRCDDCCGGRGRGRCYGPQCLCR" or "KCSPCFTTDHQSARRCDDCCGGRGRGRCYGPQCLCR" or "SCSPCFTTDHQ SARCDDCCGGGRGKCYGPQCLCR" or "SCSPCFTTDHQSARCDDCCGGGRGCYGP QCLCR" or "KCSPCFTTDHQSARCDDCCGGGRGCYGPQCLCR" or "MCMPCF
  MOD_RES (21)..(89): CONT. FROM ABOVE: TTDPNMARKCRDCCGGNGKCFGPQCLCNRG" or "MC MPCFTTDHNMAKKCRDCCGGNGKCFGYQCLCNRG" or "MCMPCFTTDHQTARRCR DCCGGRGRKCFGQCLCGYD" or "ACGPCFTTDPQMAEKCSDCCGGIGTCYGPQCL CNRL" or "MCMPCFTTRPNMAQQCRDCCRGRGKCFGPQCLCG" or "MCMPCF
  MOD_RES (21)..(89): CONT. FROM ABOVE: TTRPNMAQQCRDCCRGRGKCFGPQCLCGYD" or "MC MPCFTTNLNMEQECRDCCGGTGRCFGPQCLCG" or "GCMPCFTTDRYMARKCKEC CRGYGNCFGPQCLCNRG" or "GCGPCFTTDANMARKCRECCGGNGKCFGPQCLCN RE" or "GCGPCFTTDANMARKCRECCGGIGKCFGPQCLCNRI" or "MCMPCF
  MOD_RES (21)..(89): CONT. FROM ABOVE: TTRPDMAQQCRACCKGRGKCFGPQCLCG" or "MCIP CFTTNPNMAAKCNACCGSRRGSCRGPQCIC" or "[sequence omitted] GNGKCFGYQCLCNR" or "CGPCFTTDPYTESKCATCCGGRGKCVGPQCLCNR" o r "RCGPCFTTDPQTQAKCSECCGRKGGVCKGPQCICG" or "CGPCFTKDPETE
  MOD_RES (21)..(89): CONT. FROM ABOVE: KKCATCCGGIGRCFGPQCLCNRG" or "MCMPCFTTD HQMARRCDDCCGGRGRGKCWGPQCLCR" or "AMCMPCFTTDHNMAKKCRDCCGGN GKCFGPQCLCNRG" or "CGPCFTTDWESEKKCAECCGGIGRCFGPQCLCNRK" o r "CGPCFTTDHQTEQKCAECCGGIGKCYGPQCLCRG" or "CGPCFTTDRQMEQ
  MOD_RES (21)..(89): CONT. FROM ABOVE: KCAECCGGIGKCYGPQCLCRG" or "CGPCFTTDHQT EQKCAECCGGIGKCYGPQCLC" or "CMPCFTTDHQMARKCDDCCGGRGKCYGPQC LCRG" or "RCGPCFTTDPQTQAKCSECCGRKGGVCKGPQCICGIQ" or "RCPP CFTTNPNMEADCRKCCGGRGYCASYQCICPG" or "CGPCFTTDHNMARKCDECC
  MOD_RES (21)..(89): CONT. FROM ABOVE: GGKGRGKCFGPQCLCR" or "VCMPCFTTDQQMARKC SDCCGGKGRGKCYGPQCLCR" or "MCGPCFTTDANMARKCRECCGGIGKCFGPQC LCNRI" or "MCGPCFTTDANMAAACRECCGGIGKCFGPQCLCNRI" or "MCGP CFTTDANMARKCAECCGGIGKCFGPQCLCNRI" or "MCGPCFTTDANMARKCRE
  MOD_RES (21)..(89): CONT. FROM ABOVE: CCGGIGACFGPQCLCNRI" or "MCGPCFTTDANMAR KCRECCGGIGKCFGPQCLCNAI" or "CMPCFTTRPNMAQQCRDCCRGRGKCFGPQ CLCGYD" or "MCMPCFTTNLNMEQECRDCCGGTGRCFGPQCLCGYD" or "CMP CFTTRPNMAQQCRDCCRGRGKCFGPQCLCGYD" or "GSEISCEPGKTFKDKCNT
  MOD_RES (21)..(89): CONT. FROM ABOVE: CRCGADGKSAACTLKACPNQ" or "GSSCEPGRTFRD RCNTCRCGADGRSAACTLRACPNQ" or "GSSCEPGRTFRDRCNTCKCGADGRSAA CTLRACPNQ" or "GSSCEPGTTFRDRCNTCRCGSDGRSAACTLRACPQ" or "G SSCTPGTTFRDRCNTCRCSSNGRSAACTLRACPPGSY" or "GSSCTPGTTFRNR
  MOD_RES (21)..(89): CONT. FROM ABOVE: CNTCRCGSNGRSASCTLMACPPGSY" or "GSSCTPG ATFRNRCNTCRCGSNGRSASCTLMACPPGSY" or "GSSCQPGTTYQRGCNTCRCL EDGQTEACTLRLC" or "GSSCTPGATYREGCNICRCRSDGRSGACTRRICPVDSN " or "GSSCQPGTTFRRDCNTCVCNRDGTNAACTLRACL" or "EISCEPGKTF
  MOD_RES (21)..(89): CONT. FROM ABOVE: KDKCNTCRCGADGKSAACTLKACPNQ" or "SCEPGR TFRDRCNTCRCGADGRSAACTLRACPNQ" or "SCEPGRTFRDRCNTCKCGADGRS AACTLRACPNQ" or "SCEPGTTFRDRCNTCRCGSDGRSAACTLRACPQ" or "S CTPGTTFRDRCNTCRCSSNGRSAACTLRACPPGSY" or "SCTPGTTFRNRCNTC
  MOD_RES (21)..(89): CONT. FROM ABOVE: RCGSNGRSASCTLMACPPGSY" or "SCTPGATFRNR CNTCRCGSNGRSASCTLMACPPGSY" or "SCQPGTTYQRGCNTCRCLEDGQTEAC TLRLC" or "SCTPGATYREGCNICRCRSDGRSGACTRRICPVDSN" or "SCQP GTTFRRDCNTCVCNRDGTNAACTLRACL" or
  MOD_RES (21)..(89): CONT. FROM ABOVE: "GSMCMPCFTTDHQMARKCDDCCGGKGRGKCYGPQCLC R" or "GSACMPCFTTDHQMARKCDDCCGGKGRGKCYGPQCLCR" or "GSMCAP CFTTDHQMARKCDDCCGGKGRGKCYGPQCLCR" or "GSMCMACFTTDHQMARKC DDCCGGKGRGKCYGPQCLCR" or "GSMCMPCATTDHQMARKCDDCCGGKGRGKC
  MOD_RES (21)..(89): CONT. FROM ABOVE: YGPQCLCR" or "GSMCMPCFATDHQMARKCDDCCGG KGRGKCYGPQCLCR" or "GSMCMPCFTADHQMARKCDDCCGGKGRGKCYGPQCLC R" or "GSMCMPCFTTAHQMARKCDDCCGGKGRGKCYGPQCLCR" or "GSMCM PCFTTDAQMARKCDDCCGGKGRGKCYGPQCLCR" or "GSMCMPCFTTDHAMARK
  MOD_RES (21)..(89): CONT. FROM ABOVE: CDDCCGGKGRGKCYGPQCLCR" or "GSMCMPCFTTD HQAARKCDDCCGGKGRGKCYGPQCLCR" or "GSMCMPCFTTDHQMAAKCDDCCGG KGRGKCYGPQCLCR" or "GSMCMPCFTTDHQMARACDDCCGGKGRGKCYGPQCL CR" or "GSMCMPCFTTDHQMARKCADCCGGKGRGKCYGPQCLCR" or "GSMC
  MOD_RES (21)..(89): CONT. FROM ABOVE: MPCFTTDHQMARKCDACCGGKGRGKCYGPQCLCR" or "GSMCMPCFTTDHQMARKCDDCCAGKGRGKCYGPQCLCR" or "GSMCMPCFTTD HQMARKCDDCCGAKGRGKCYGPQCLCR" or "GSMCMPCFTTDHQMARKCDDCCG GAGRGKCYGPQCLCR" or "GSMCMPCFTTDHQMARKCDDCCGGKARGKCYGPQC
  MOD_RES (21)..(89): CONT. FROM ABOVE: LCR" or "GSMCMPCFTTDHQMARKCDDCCGGKGAGK CYGPQCLCR" or "GSMCMPCFTTDHQMARKCDDCCGGKGRGACYGPQCLCR" or "GSMCMPCFTTDHQMARKCDDCCGGKGRGKCAGPQCLCR" or "GSMCMPCFTT DHQMARKCDDCCGGKGRGKCYAPQCLCR" or "GSMCMPCFTTDHQMARKCDDCC
  MOD_RES (21)..(89): CONT. FROM ABOVE: GGKGRGKCYGAQCLCR" or "GSMCMPCFTTDHQMAR KCDDCCGGKGRGKCYGPACLCR" or "GSMCMPCFTTDHQMARKCDDCCGGKGRGK CYGPQCACR" or "GSMCMPCFTTDHQMARKCDDCCGGKGRGKCYGPQCLCA" o r "MCMPCFTTDHQMARKCDDCCGGKGRGKCYGPQCLCR" or "ACMPCFTTDHQ
  MOD_RES (21)..(89): CONT. FROM ABOVE: MARKCDDCCGGKGRGKCYGPQCLCR" or "MCAPCFT TDHQMARKCDDCCGGKGRGKCYGPQCLCR" or "MCMACFTTDHQMARKCDDCCGG KGRGKCYGPQCLCR" or "MCMPCATTDHQMARKCDDCCGGKGRGKCYGPQCLCR " or "MCMPCFATDHQMARKCDDCCGGKGRGKCYGPQCLCR" or "MCMPCFTA
  MOD_RES (21)..(89): CONT. FROM ABOVE: DHQMARKCDDCCGGKGRGKCYGPQCLCR" or "MCMP CFTTAHQMARKCDDCCGGKGRGKCYGPQCLCR" or "MCMPCFTTDAQMARKCDDC CGGKGRGKCYGPQCLCR" or "MCMPCFTTDHAMARKCDDCCGGKGRGKCYGPQC LCR" or "MCMPCFTTDHQAARKCDDCCGGKGRGKCYGPQCLCR" or "MCMPC
  MOD_RES (21)..(89): CONT. FROM ABOVE: FTTDHQMAAKCDDCCGGKGRGKCYGPQCLCR" or "M CMPCFTTDHQMARACDDCCGGKGRGKCYGPQCLCR" or "MCMPCFTTDHQMARKC ADCCGGKGRGKCYGPQCLCR" or "MCMPCFTTDHQMARKCDACCGGKGRGKCYG PQCLCR" or "MCMPCFTTDHQMARKCDDCCAGKGRGKCYGPQCLCR" or "MC
  MOD_RES (21)..(89): CONT. FROM ABOVE: MPCFTTDHQMARKCDDCCGAKGRGKCYGPQCLCR" or "MCMPCFTTDHQMARKCDDCCGGAGRGKCYGPQCLCR" or "MCMPCFTTDHQMA RKCDDCCGGKARGKCYGPQCLCR" or "MCMPCFTTDHQMARKCDDCCGGKGAGK CYGPQCLCR" or "MCMPCFTTDHQMARKCDDCCGGKGRGACYGPQCLCR" or
  MOD_RES (21)..(89): CONT. FROM ABOVE: "MCMPCFTTDHQMARKCDDCCGGKGRGKCAGPQCLCR" or "MCMPCFTTDHQMARKCDDCCGGKGRGKCYAPQCLCR" or "MCMPCFTTDH QMARKCDDCCGGKGRGKCYGAQCLCR" or "MCMPCFTTDHQMARKCDDCCGGKG RGKCYGPACLCR" or "MCMPCFTTDHQMARKCDDCCGGKGRGKCYGPQCACR"
  MOD_RES (21)..(89): CONT. FROM ABOVE: or "MCMPCFTTDHQMARKCDDCCGGKGRGKCYGPQCL CA"
  See specification as filed for detailed description of substitutions and preferred embodiments
METDTLLLWVLLLWVPGSTGXXXXXXXXXXXXXXXXXXXXXXXXXXXXXXXXXXXXXXXXXXXXXXXXXXXXXXXXXXXXXXXXXXXXXEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1494 - protein, 292 aa, Artificial Sequence
  Description of Artificial Sequence: Synthetic polypeptide
METDTLLLWVLLLWVPGSTGGSGVPINVRCRGSRDCLDPCRRAGMRFGRCINSRCHCTPGGSGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1495 - protein, 20 aa, Artificial Sequence
  Description of Artificial Sequence: Synthetic peptide
  MISC_FEATURE (1)..(20): This sequence may encompass 3-20 residues
RRRRRRRRRRRRRRRRRRRR

SEQ ID NO: 1496 - protein, 4 aa, Artificial Sequence
  Description of Artificial Sequence: Synthetic peptide
GAGA

SEQ ID NO: 1497 - protein, 4 aa, Artificial Sequence
  Description of Artificial Sequence: Synthetic peptide
GFLG

SEQ ID NO: 1498 - protein, 10 aa, Artificial Sequence
  Description of Artificial Sequence: Synthetic 10xHis tag
HHHHHHHHHH

SEQ ID NO: 1499 - protein, 6 aa, Artificial Sequence
  Description of Artificial Sequence: Synthetic peptide
PLGLAG

SEQ ID NO: 1500 - protein, 19 aa, Artificial Sequence
  Description of Artificial Sequence: Synthetic peptide
METDTLLLWVLLLWVPGST

SEQ ID NO: 1501 - protein, 211 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 1502 - protein, 211 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANDSLSSNGNVTESGCKECEELEEKNIKEFLQSFVHIVQMFINTS

SEQ ID NO: 1503 - protein, 339 aa, Artificial Sequence
  Description of Artificial Sequence: Synthetic polypeptide
  MOD_RES (254)..(303): This region may encompass one of the following sequences: "VA" or "VK" or "VR" or "V-Cit" or "FK" or "MK" or "NK" or "IP" or "GI" or "GL" or "GY" or "GM" or "MI" or "AI" or "PI" or "GPQGIAGQ" or "GPQGIFGQ" or "GPQGIWGQ" or "GPQG
  MOD_RES (254)..(303): CONT. FROM ABOVE: ILGQ" or "GPQGIRGQ" or "GPLGIAGQ" or "GPMGIAGQ" or "GPYGIAGQ" or "DYKDDDDKIEGR" or "GGSGGG GSGGGSGGGGSLQ" or "GGSGGGGSGGGSGGGGS" or "SGGGSGGGGSG GGGSGGGGSGGGSLQ" or "SGGGSGGGGSGGGGSGGGGSGGGS" or "GG
  MOD_RES (254)..(303): CONT. FROM ABOVE: GGSGGGGSGGGGSGGGGSGGGGSGGGGSGGGGSGGGG SGGGGSGGGGS, this region may encompass 1-10 'Gly4Ser' repeating units" or "GS" or "SGGSGGGGSGGGSGGGGSLQ" or "GGGS" or "GGGSGGGS" or "GGGSGGGSGGGS
  MOD_RES (254)..(303): CONT. FROM ABOVE: GGGSGGGSGGGSGGGSGGGSGGGSGGGS, this region may encompass 1-10 'Gly3Ser' repeating units" or "GSVAGS" or "GGGGSVAGGGGS" or "GGGGSGGGGSVAGGGGSGGGG S" or "GGGGSGGGGSPLGLAGGGGGSGGGGS" or
  MOD_RES (254)..(303): CONT. FROM ABOVE: "AEAAAKEAAAKAVAAEAAAKEAAAKA"
  MOD_RES (254)..(303): Any amino acid or absent
  See specification as filed for detailed description of substitutions and preferred embodiments
MAPRRARGCRTLGLPALLLLLLLRPPATRGDYKDDDDKIEGRITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSXXXXXXXXXXXXXXXXXXXXXXXXXXXXXXXXXXXXXXXXXXXXXXXXXXMCMPCFTTDHQMARKCDDCCGGKGRGKCYGPQCLCR

SEQ ID NO: 1504 - protein, 339 aa, Artificial Sequence; identical to SEQ ID NO: 1503
  Description of Artificial Sequence: Synthetic polypeptide
  MOD_RES (254)..(303): Any amino acid or absent

SEQ ID NO: 1505 - protein, 33 aa, Artificial Sequence
  Description of Artificial Sequence: Synthetic polypeptide
GDCLPHLKLCKENKDCCSKKCKRRGTNIEKRCR

SEQ ID NO: 1506 - protein, 33 aa, Artificial Sequence
  Description of Artificial Sequence: Synthetic polypeptide
GDCLPHLKRCKADNDCCGKKCKRRGTNAEKRCR

SEQ ID NO: 1507 - protein, 35 aa, Artificial Sequence
  Description of Artificial Sequence: Synthetic polypeptide
SEKDCIKHLQRCRENKDCCSKKCSRRGTNPEKRCR

SEQ ID NO: 1508 - protein, 45 aa, Artificial Sequence
  Description of Artificial Sequence: Synthetic polypeptide
TDDEEARWIEKRGDCLPHLKLCKADKDCCSKKCKRRGTNPEKRCR

SEQ ID NO: 1509 - protein, 33 aa, Artificial Sequence
  Description of Artificial Sequence: Synthetic polypeptide
GDCLPHLKRCKENNDCCSKKCKRRGTNPEKRCR

SEQ ID NO: 1510 - protein, 33 aa, Artificial Sequence
  Description of Artificial Sequence: Synthetic polypeptide
GDCLPHLKRCKENNDCCSKKCKRRGANPEKRCR

SEQ ID NO: 1511 - protein, 44 aa, Artificial Sequence
  Description of Artificial Sequence: Synthetic polypeptide
CGAQTQRIRCRVPCNWKKEFGADCKYKFENWGACDGGTGTKVRQ

SEQ ID NO: 1512 - protein, 34 aa, Artificial Sequence
  Description of Artificial Sequence: Synthetic polypeptide
SGSDGGVCPKILKKCRRDSDCPGACICRGNGYCG

SEQ ID NO: 1513 - DNA, 70 bp, Artificial Sequence
  Description of Artificial Sequence: Synthetic oligonucleotide
cagacgggcacacactacttgaagcactcaaggcaagctttattgaggcttaagcagtgggttccctagt

SEQ ID NO: 1514 - DNA, 62 bp, Artificial Sequence
  Description of Artificial Sequence: Synthetic oligonucleotide
caggggggaccactcttaagcctcaaggcaagctttgttgaggcttaagagtggtcccgggt

SEQ ID NO: 1515 - DNA, 70 bp, Artificial Sequence
  Description of Artificial Sequence: Synthetic oligonucleotide
caggggggcacacactacttgaagcactcaaggcaagctttgttgaggcttaagcagtgggttcccgggt

SEQ ID NO: 1516 - RNA, 28 nt, Artificial Sequence
  Description of Artificial Sequence: Synthetic oligonucleotide
gggaggucagcuacuuucauguugcuga

SEQ ID NO: 1517 - RNA, 80 nt, Influenza A virus
aguagaaacaaggguauuuuucuuuaauugucguacuccuugaugucacucagugagugauuaucuacccugcuuuugcu

SEQ ID NO: 1518 - RNA, 70 nt, Influenza A virus
accaaacaaagauuuggugaaugacgagacuacacgccuuuuaucguaacucaccgauucucuguuuggu

What is claimed:

1. A composition comprising a peptide-immuno-oncology agent complex, the peptide-immuno-oncology agent complex comprising a peptide complexed with an immuno-oncology agent, wherein the peptide of the peptide-immuno-oncology agent complex comprises:
   at least 4 cysteine residues, and
   a plurality of disulfide bridges formed between the cysteine residues;
wherein the peptide is tumor-homing,
wherein the immuno-oncology agent comprises an IL-15 agent, and
wherein the peptide-immuno-oncology agent complex comprises:
   a) SEQ ID NO: 1330;
   b) SEQ ID NO: 1340; or
   c) any one of SEQ ID NO: 1317, SEQ ID NO: 1328, SEQ ID NO: 1435, SEQ ID NO: 1437, or SEQ ID NO: 1441.

2. The composition of claim 1, wherein the peptide comprises:
   a) SEQ ID NO: 568; or
   b) SEQ ID NO: 569.

3. The composition of claim 1, wherein the IL-15 agent comprises SEQ ID NO: 1177, SEQ ID NO: 1176, or SEQ ID NO: 1433.

4. The composition of claim 1, wherein the IL-15 agent comprises a fusion of an IL-15 domain and an IL-15Rα sushi+ domain.

5. The composition of claim 1, wherein the peptide is cell penetrating, blood brain barrier penetrating, or a combination thereof.

6. The composition of claim 5, wherein the cell penetrating comprises uptake into an endosome; uptake into a subcellular compartment; uptake and processing in a subcellular compartment and secretion; uptake and delivery to cytoplasm; uptake and transcytosis; uptake and nuclear localization; uptake and extracellular presentation; pinocytosis; uptake, cleavage, and secretion into a tumor microenvironment; or uptake and presentation on a cell surface protein.

7. The composition of claim 1, wherein the peptide and the immuno-oncology agent are chemically conjugated or conjugated through recombinant fusion.

8. The composition of claim 1, wherein the peptide and the immuno-oncology agent are linked via a cleavable linker.

9. The composition of claim 8, wherein the cleavable linker is cleaved upon delivery to a tumor microenvironment, on the surface of a cell in the tumor microenvironment, on the surface of a tumor cell, within a cellular cytoplasm, or an intracellular compartment.

10. The composition of claim 1, wherein upon administration to a subject the peptide homes, targets, migrates to, accumulates in, binds to, is retained by, is processed by, or is directed to a cancer of the subject.

11. The composition of claim 10, wherein upon administration to the subject the immuno-oncology agent of the peptide-immuno-oncology agent complex stimulates a host immune response against the cancer.

12. The composition of claim 10, wherein the cancer is a solid tumor, a metastatic cancer lesion, a central nervous system cancer, glioma, glioblastoma, a brain cancer, a brain tumor, breast cancer, ovarian cancer, melanoma, sarcoma, basal cell carcinoma, squamous cell carcinoma, skin cancer, lung cancer, colon cancer, colorectal cancer, pancreatic cancer, prostate cancer, bladder cancer, or any combination thereof.

13. A method of treating cancer in a subject in need thereof, the method comprising:
administering to the subject a composition comprising a peptide-immuno-oncology agent complex, the peptide-immuno-oncology agent complex comprising a peptide complexed with an immuno-oncology agent, wherein the peptide of the peptide-immuno-oncology agent complex comprises:
at least 4 cysteine residues, and
a plurality of disulfide bridges formed between the cysteine residues;
wherein the immuno-oncology agent comprises an IL-15 agent, and
wherein the peptide-immuno-oncology agent complex comprises:
a) SEQ ID NO: 1330;
b) SEQ ID NO: 1340; or
c) any one of SEQ ID NO: 1317, SEQ ID NO: 1328, SEQ ID NO: 1435, SEQ ID NO: 1437, or SEQ ID NO: 1441; and
delivering the immuno-oncology agent to the cancer, wherein the cancer is a solid tumor, a metastatic cancer lesion, a central nervous system cancer, glioma, glioblastoma, a brain cancer, a brain tumor, breast cancer, ovarian cancer, melanoma, sarcoma, basal cell carcinoma, squamous cell carcinoma, skin cancer, lung cancer, colon cancer, colorectal cancer, pancreatic cancer, prostate cancer, bladder cancer, or any combination thereof, thereby treating the cancer.

14. The method of claim 13, wherein delivering the immuno-oncology agent to the cancer further comprises homing the peptide of the peptide-immuno-oncology agent complex to the cancer.

15. The method of claim 13, further comprising stimulating a host immune response against the cancer.

16. The composition of claim 1, wherein the peptide-immuno-oncology agent complex comprises SEQ ID NO: 1330.

17. The composition of claim 1, wherein the peptide-immuno-oncology agent complex comprises SEQ ID NO: 1340.

18. The composition of claim 1, wherein the peptide-immuno-oncology agent complex comprises SEQ ID NO: 1317.

19. The composition of claim 1, wherein the peptide-immuno-oncology agent complex comprises SEQ ID NO: 1328.

20. The composition of claim 1, wherein the peptide-immuno-oncology agent complex comprises SEQ ID NO: 1435.

21. The composition of claim 1, wherein the peptide-immuno-oncology agent complex comprises SEQ ID NO: 1437.

22. The composition of claim 1, wherein the peptide-immuno-oncology agent complex comprises SEQ ID NO: 1441.

* * * * *